United States Patent 10,407,724 (METHODS AND COMPOSITIONS FOR SCREENING AND TREATING DEVELOPMENTAL DISORDERS) - sequence listing, part 30

SEQ ID NO: 627 - DNA, 1539496 bp, Homo sapiens
  misc_feature (268869)..(418868): n is a, c, g, or t
  misc_feature (1371074)..(1521073): n is a, c, g, or t
gccagccactcacttcagtaggatctcctgggtctagagaaatagcaaatattcaggagctcatatatatccttggcctcacaaaaatgaaaaattctaaccctcctcatccttctataattctgaacttaaaccagctggagggcaaccctagtcactacctttatattacaagcaagttccagctggttccatcaacaaagatccatttactgttatatggaacaatttaattttctactaaaaactggatttttaacaactataaatggcaaacattacttattgcagaaatctgcaaaatgcaaagactaattttaataaaaattagtctttttaggcactttctgcaaatatacaaaccacaaaagagacattacacattattcagcacccctgctatactaagggaactttgaatatacgtaaatgtaagccaaagactcttttcggaaaacctccacattaaaaaaaaaaaaaaggagggtggttgcaaagcagtgtaaaaagggaaataaggtccctagaagggaatataattactatttcccattaaaagtaaaatataaagtaacattaaaagtaactataaaatagttaaggcataatttgcaggtcaccataacctgctgaaagctattctaaaatattatttcacaccatagcatgatgccagggatttgtttccaaagaatctggtgaacacagcaatggggataaaatagttcataagctgataaatgttggagagagggagtaggagggggttcattatcttattctaacatcatatatgtttgaaattgtctccattaaaatactttaaaaactactagacattattgatgaacaaatttaattttcatatcctaaaaacaaagaaagatgagtaccttccaatcttcgaatttttgctttcacagaaataacagtttcaaaaggtgaaactctcagctcaaaacatgttccagttaatgtttcaatgaagagctccatggtatcacagaaatgaagtctgtagtaaaatggtcccatgttatcatcattgaagaatggaggctcttttctgttatccattactttgacttttctagttcttctaaaatatgtcgcaggcaactgtattccagttctaggcaaaccaggtttgaagattggtaatatatattgttgttcatgttttgagttttgtacctaaaaaaacaagaatttttttaacaagcctatctgaaagttgtatttgtccataaagattttccgttaactgtggcccatatcaatcttccagacggccccagaattcactttagtgcttttaattatgtctaatcctgaacttttcacatttgtctctgaaatcactctcccatctagaccataagattattaagaatacgcatatttttgatattataatgtatcttactagagctcagcacagttatatatatagtacatgctcaacaaatacttttgttgttaagtgatatataagccaaactcaacaaacacatcagtatatttctgtaaggctttgaaaaatttattcatatccttttctaaaacatacaaattatgtcttctataccatataaagcataactttacaacgattgtacatttgactttttttttttttttgacagagtctcgctctgtcgccaggctggagtgcagtggcacaatctcggctcactgcaacctccgcctcccgggttcaagcaattctcctgcctcagcctcccaagaagctgggattacaggcacccaccaccatgcccagcagatttttgtatttttagtagagacggggtttcaccacgttggccaggatggtctcgatctcttcaccttgtgatccacccgcctcggcctcccaaagtgctgggattacaggcgtgagccaccatgcctactcctgttgtatatttgaatcatactggataaaaggaatgccaaccaccataataggttgcttaaaaatagtactcactaggctgggggctgtggctcatgcctgtaatcccagcactttgggaggccgagatggcagatcatgatgaggtcaggagatcgagaccatcctggctaacatggtgagacccaatctctactaaaaatacaagaaaaaaatgagctgggcgtggcggtgtctgcctgtagtcccagctacttgggaggctgaggcaggagaatggcgtgaacccgggaggcagagcttgcggtgagccgagattgcgccacaacaccccagcctgggcaacagagcaagactctggtctcaaaaacaaaaaaaagtagtactcactaaatcatcaacggtttccagaggatattatagcattcagatgacattagaattggtaataagtattagacaatctctgctcacatacatacaatggctaataagtatgagtggtaagcccaacaaatagaagtagtaaactaaatgacaagtatagaactaggagcacaaaaatgatcaaattgctattgctattaatcgtgaaaactctatacaggggggccttgaacttaaactaggacaaatgatacacatctttctggtgaggtggttaaacctttttaaaaatagctttattgagggccaggcacagtggctcacacctgtaatcccagcacgttgggaggccgaggtgggcggatcacctgaggtcaggagttcgagaccagcctggccaaaatggcgaaaccccatctctaccaaaaaatacaaaaattagccaggaatggtggcgcacacctgtagtcccagctactcgggaggctgaggcaggagaaccgcttgagtccaggaggcagaggttgcagtgagccaagattgcaccactgcactccaacctgggtgacagagcaagactccatcattaaataagaaaaaaaaagctttattgaaatataattcacatgccataaaattcactcatttaaagcctaaaattcactggtttttatgatgtacacagagttgtgcaacaatcaccacatttgctttagaaaattttcattacctctaaaaggaaccccataccctgtaaccaacactcccaaattcccccagtcccccactcaaccctaggcaaccactaatctactttctatctccaaattggtctattctggacatttcacataaatagaatcatatatgatttttttgtgactggcttctttcacttagcataatgttttcaaagttcatcatgttctaggatatatcagtatttcactcctttttattgctgaataatagtcccctgtagcaatatatctcatgttgtttatccatccatcagttgatgagcatttgagtcgtttccaattttgggctgttacatatagtgctaagatgaacattcaactgcaagtttttgtgtaaacatatgttttcctttctctttgaagtagctttgctagataatgtggtaactcttatgtttggcaatttgtggaactaccaaactgttttctaaatggtatggatcattttatagtcccatcaacaatgaatgagggtgccaatttctccacacccttgacaatacttgtttctgtccttttgattaaagctatcctagtgggtgtgaagtagtatctcactgtggttgacttccatttctttaaaaactaatgatattgtgcatcttttttatgtgattattggccatttgcatacattctttggagaaatgcctattcatatactttgtctattttttaattggattttttattgagttgtatgagtttttatattacatattctagataaaaacacttaacagatatatgaatggtaaatattttctctcattttgtgggttgtcttttgatagtatcttttgaaacacaaaggtttttaattttgttaaactctaatttggctatttttcttttatcatacttaaaaagcttggcttaacccaaggtaataaagattgacttatatatgtttctaaaaattgtagttttagctcttatgtttaggtgtactgtccaatttcaatttagttttgtgtatggtgtgaggtagagtctaactttattcttttgcatgtggataaccagttgttccagtatcatttgtcagaattaccattcattcccaattgaattgtcttggatccttgttaaaaaccaatttactgtaaatgtgaaggtttatttccagactctttattctgttgatctacctatgccagtaccaccacatcttaattaatgtagctttgtagtaagttctgaaatcaggaagtgtgaggcctccaatttgttctttttagattgttggctattctggactccttgaattgccatatgaattttaagtatgcccattttgcaaaaatgtcagctgggattttgacagggattgtattaagtctgtagatttggagagtactgcaatcttaatactaagtcttctaatccataaatacatactatttttcagtttatatctaatttatttcaatgttttataatttttaaagcacaagttttgttctcttttattaaatttattcctaagtattttattcctttaaatgctattacaaatggaatcactgtcttatttacagattgctcattgctggtttatagaaacacaaccgattttaatatcttgatcctgtacactgcaactgtgctgaactgtttatttcgttcatttagttatttaaatcttcctaaacgctctctataaaagctctatatacaagatcatgtcatttacaaatagagttttacttctccctttctaatctatatgctcttttctttctttttttttttttttttttttttggagggggtgaaagtcccactctgttgcccgggctgaagtgaaatggcacgatctccgcttattgtaacctccgcctcccgagttcaagcgattcgcctgtctcagcttcccaaatagctgggattacaggcacctgccaccacaccaggcaaatttttgtatttttagtagagacaaggttttaccaagttggccaggctggtctcgaactgctgacctcaggtgacccacccaccctggcctcccaaagagctgggattacaggcctgagccactgcactgggcttatttccctttcttgcctaattgccctgctctggaaccttcagtacaagattgaataaaagtggtgagactggacatccttgtctaattcttgattgtagaaggaaaccattgagtctttaggtataatgttaaccgtggggttttcatagattaccaatataaggttgacgagcttcccttctattcctgctttaggtgggttttctttttaatcatgaaggggtgccaattttatcaaacgcttttttcattgtctattgaaataatcatttggttttctttacttttttattcacatattacattactttttatgtgtcaaatcaatcttgcattactggggtaaatcccatttgtacctggtatgtaatcctttacatatgttgatggatttgatctgaaaatatttcctcaggatttctgtgtctataatcacaagagatgatgatctgtagttttcattatgtctgtcaggatttggtatcagggtaatattggccttagccaaactaagcttcgtaagtgaaggagaaataaaatcctttacagacaagcaaatgctgagagattttgtcaccaccaggcctgccttacaagagctcctgaaggaaacactaaacatggaaaggaacaaccggtaccagccactgcaaaaacatgccaaatggtaaagaccattgatgctgtgaagaaactgcaacaattaatgggcaaaataaccagctaacatcataaagacaggatcaaattcacacataacaatattagccttacatgtgagtgggctaaatgccccaattaaaagacattttaatgtctggcaaattcttctcagcaccacatcgcacttattccaaagttgaccacatagctggaagtaaagcactccttagcaaatgtaaaacaacagaaatcacaacaaactgtctctcagaccacagtgcaatcaaattataactcaggattaagaaactcactcaaaactgcacaactacatggaaactgaacaacctgctcctgaatgactactgggtaaataacgaaatgaaggcagaaataaagatgttctttgaaaccaatgagaacaaagacacaacgcaccagaatctctgggacacatttaaagcagtgtgtacagggaaatttatagcactaaatgcccacaagagaaagcaggaaagatctaaaattgacaccctaaaatcacaattaaaagaactagagaagcaagagcaaacaaattcaaaagctagcaggaggcaagaaataactaagatcagagcagaactgaaggaaatagagacacaaaaatcccttcaaaaaatcaatgaatctgagagctggttttttgaaaagatcaacaaaattgatagattgttagtaagactaaagaatcaaatagatgcaataaaaaaagataaaggggatatcaccagcgatcccacagaaatacaaactaccatcagagaataccataaacacctctacacaaataaactggaaaatctagaagaaattgataaattcctggacacatataccttcccaggactaaaccaggaagaagtggaatctctgaagaaaccaataacaggctctgaaattgaggcaataattaatagcctaccaacaaaaaaagtccaggtccagatggattcacagccaaattctaccaggggtacaaagaggagctggtaccattccttctgaaactattccaatcaatagaaaaagagggaatcctccctaactcattttatgaggccagcatcatcctgataccaaagcctggcagacacacaacaaaaaaagagaattttagaccagtatccctgatgaacatctatgcgaaaatcctcaataaaatactggcacaccgaatccagcagcacatcaaaaagcttatccactatgatcaagtcggcctcatccctgggatgcaaggctggttcaatacaggcaaatcaataaatataatccatcacataaacagagccaatgacaaaaaccacatgattatcttaatagatgcagaaaaggcctttgacaaaatccaacagctcttcatgctaaaaactcttaataaactaggtattgatggaacgtatctcaaaataataagagctatttatgacaaactcacagccaatatcatagtgaatgggcaaaaactggaagcattccctttgaaaaccggcacaagacagggatgccctctctcaccactcctatttaacacagtgttggaagttctggccagagcaatcagacaggagacagaaataaaggatattcaattaggaaaagaggaagtcaaattgtccctgtttgcagatgacatgattatacatttagaaaaccccatcgtcccaacccaaaatctccttaagctgataaacaacttaagcaaagtctcagggtacaaaatcaatgtgcaaaaatcacaactatctgattttttttttttttttttgagacggagtttcacttttgttgcccaggctggagtgcaatggtgtgatcttggctcaccacaacctccgcctcccagattcaagtgattctcctgcctcagcctccctagtagctgggattacaggcatgtgccaccacgcccggctaatttttttgcatttttagtagagatttctcccaacaggggtttctccatgttcgtcaggctggtctcaaactctcaacctcaggtgatccgcctgcctcggcctcccaaagtgctgggattacaggcgtaagccactgtgcccagcctacaaccatctttgacaaacctgacaaaaacaagacgtagggaaatgattccctatttaataaatggtgctgggaaaactggctagccatatgtagaaagctgaaactggatcccttccttacaccttatacaaaaattaattcaagatggattaaagacttaaatgttagacctgaaaccataaaaaccctagaagaaaacctaggcaataccattcaggacataggcatgagcacggacttcatgactaaaacaccaaaagcaatggcaacaaaagccaaaatagacaaatgggatctaattaaactaaagagcttctgcacagcaaaagaaactaccatcagagtgaacaggcaacctacagaatgggaaaaaaattttgcaatctacccatctgacagagggctaatatccagaatctacaaagaacttagacaaattttcaagaaaaaaacaaccgcatcaaaaagtgggcaaaggatatgaacagacagttctcaaaagaagatatttatgcagccaacagacacatgaaaaaacactcatcatcactggtcatcagaaaaatgcaaatcaaaaccacagtgagataccatctcacaccagttagaatggcgatcattagaaagttaggaaacaacagatgctggagaggatgtgtagaaataggaacacttttacactgttggtgggactgtaaattagttcaaccgttgtggaaaacagtgtggcaattcctcaaggatctagaactagaaataccatttgacccagcgatcccattactgggtatatacccaaaggattataaatcatgccactataaagacacatgcacacgtatgtttactgtggcacaattcacaacagcaaagacttggaaccaacccaaatgtccatcagtgatagagtggattaagaatatgtggcacatatacaccatggaatactatgcagccataaaaaaaggatgagttcatgtcctttgcatggacatggatgaagctggaaaccatcattctcagcaaactgtcacaaggacagaaaaccaaacaccgccatgttctcactcatagatgggaactcaacaatgagaacacttggacacagggaggggaacatcacacactggggcctgtcgtggggagtgagatggggggagggatagcattaagagaaatacgcaatataaatgacgagttagtcggtgcagaaaaccaacatggcacatgtatagctatgtaccaaacctgcacgttgtgcacatgtaccctagaacttaaaaaaaaaaaaaaaatcaattcccaaagcatttctctcatttcttctgaaaagtttctaaaaacacaactccaaggatgaaatggaagttaaaggtaaacaggcaatagcgctgaatacgtaatttcagtaactcagaattttctccaacctctgctctaaagaagcttagctacagaagagcagttacctttgaaacattttccccaacataaagatatccggaatgtgaagctgccattaaaactgtgacacagatctacatttactgatacatcaaaacatccctaaagttcgaaatacgagctacagaatcacatcaaccgcctaacttgtctgtagcctaaactctagtccggagttcatctgcaagcggaattgggaagtatttcagagccagcatctcctcgcgccatccaggtacctacacacttgaggccaccgagtcacctgcgcagccgttgctcctccaagaccaatccgggctccccagacccaccggcctgaatctggaggacagcagtccgcgtgacaacagcgactcggagatcagcacccgtcgggaaagccgcgtacccgttgaagctggcgtcacgcccaaaggaacaaacgccagagcgtgtgtcctgggcaaaggcggcccgccgctccggtccccgggcagcagcggccggcgtcaggccgcaaggcgaggggcggggacaggactctacccggcagcccagcgccgagcgcccgcgccactccggccttgcgccattccggccccacgacggccggcggcggcagcgcggctgggctcagcggctcgcagcccgggcgccccccctgccggccgctcgctagctcagcctcacccgcagtcttgtccgctggctcgctcgcccgcctacaggtcgacagggcccaacgacccggcgagcaacttcacggaaggcactggccgacaacgctccgctgccgccgcgccccgcccctttgtgacaccacctaccaatcgctggacggcgctttcgctgccctccaatcagcgcgggcgggggcaggcctggcccccggacgtgggcggttgccggggcgccagggccctggggccttcttggcattcgctggaggttgtgagttacgaggcccggatgttgatcttttattactagcaacactggacccctgactcgtgcccacgcgggcgtctggagggcagccgcatggcctgctgggaacggcggggttgaagccggagccgccctccgtgagacccaccggggatcctcttccaggcgcctgatttgctggagataggcgatacaggcagacgctgtccagtcggtggcctctccagagtgaggggcgctcctggtgcgtttgggccggcctgtcctaacaaatctgctttaggcttcaccgtcccctaatgtttctggcctcaattgcctcatctggaaaatgggggcattaccgtgcctgcttgaagacaaaggcgaaaacagataactttctgtagtcctcatacaatttactgagaactgtaggccaggcaatggagtaggcaccctgggctcaaatcccagcgttgggtaagcccagccacacctcctgctccagtttccaagctgctgagctgcggtgtaaacagtaactggcttcaagccaacacctgcctttcaacctaacatgggagcccactgcctcgttccgttccccctaccgattttccaactccgtgaacctccttcactaagtgggttactcagctgacaaagaatgtcatctcactcccactgcgggttcactcatcctcgacttctggctcagaggagccagtctaatatgaaactaaacatctaatctgtgtctcctgtcctctctcattcttctgagaccctacccaccaacttatctccacagttcaacgaactattgagcatacactgggggagtatggtgaggcactgggcattgattcaccagtctcgccgttggttccttctgaaactccacatatgcttaatgctaaatagattggagacctttgaggacagagctatgatggtaatcatctttgcattcctgagcctagaatagggcctgtgatggagacttactgagtaaaaaccttagcgtttctcacccttgcctgcccacttcattcacactggagaattgacagcatggaccgtggagtcaggcaggtgtgtttaaagccttgcctcccaataccagaagctccattacctggccaagtcattcattctttacaacatcatcatcattatcatctgccattcttcaagtgccagatagttgataagggtctttacgtattctctccccatcacaatcctgcaaagttggtagtgaaatccctcgtctacaaaggagtaaacaaaagccaattaaagtagaacaatttacctataatcaaacagctctatgtcggaaagccatatttaaactaggacacaatacaaaaatccaaccttgttccattattccacattgcttccagattttagctttatctgtaaaattagtgttactacattacctatctgatagaccatggagactgaataaaatagcattaaaagttgttaccataggaacttttttttaacgtaagttctctctccctttcaagcctctcaaaatagcagcttgcgtattttctaaacctgttgtctcctgaatcccctgaaaccaatcctactgattgatgagtagatttagttgttccaaaagaaaatcatcgtatttaacaaatgctgactctgaccgacattgggtactacagcaagaaactatgtgcacaaataacctacggacagaaggaagatgcataaaatgaataggggaaaggagtggccaactagcaagtgccctcatctgtcatcacgtcactctcacagcagacttgggcaaatggttgacctgtgggagctgaacaaaatctttgactctgggtatgagtaattccctgtctgatcttacagtgcccaaggaagaagtcagtagctccaggatcgctgagaccaacctgggcggcctacaagactgcaccatggtgacaggctgaatagtcagcagcaagacgacagagcaccaaaaaacacagactagaatggggtcagccatccaggtggctagtggctactgcctttgacgatgcagataaagaaaattttcattcctgcagagttctatggggcagtgctgctctagaggctgacatttctatcctcagcacttcccccggctattacctaggttcattctgctgcttccacaaggcaagaatggaacagaatgccttagagcaatggtcagcgaactgtttatgtaaaggggcagggccaggcgcagtggctcacgcctgttatccccgcactttgggaggccgaggcaggtggatcacgaggtcaggagttcaagaccaacctggccaacatggtgaaaccccaactctactaaaaatacaaaaattagctgggtgtgatggcaggcgcctgtaatcccagctactcgggaggctgaggcaggagcatcgcttcaacccaggaaatagaggttgcagtgagccaagatcacatgactgcactccagcctgggtgacagagcaagactccgtctcaaaaaaataaataaaaggggcagatagaaaacatctgaggctctgtgagccatccggtctcgtcataattactcaactcttacattggaggtagggtgaaagcaacaatagaaagtaagtaaatcaatgaatgtggttgtgttccaataaaactttattaacaagatcagacagtgggggggggggggtagcatagtttgccaaacgaaaatccaataaaaatttattaaagatttaaatgtggccaagcgtggtggctcatgactgtaatcccagcactttgggaagcggaggcgggtggatcacaaggtcaggaggtcgagaacatcctggccaacatggcaaaaccctgtctctactaaaagcacaaaaattagctgggcgtggtagcgcgtgcctatagtcccagctactcaggaggctaaggcaggagaatcacttgaacccgggaggcgaaggctgcagtgagtcgagatcgcaccactgcactccagcctgggcaacagagcgagactctgtctccaaaaaaaaaaaaatcaaaaaacaacatttaagtgtaagacctgaaatgagaaaacttttcttttaggtttttgtctagaagtttctaggtattgatcttgacaataatttacagaatatgtcacaaaagtggagacatgaaaagccaaactaaacatgggacaatgccaaattgaaaaccttcacagcaaagaaaccaatgaacaaattaaaaagctttttaacaattatccaaaatacctaaagaacttgtattaataaataggaaaaaaaactgaaacaaaacagaaaagcatcaaaaagcttaaaaataagcagatttggccgggcacggtggctcatgcctgtaatcccagcactttaggaggccgaggtggacggataacctgaggtcgggagttcgagaccagcctgaccaacatggagaaaccctatctctactaaaaatacaaaattagccgggcatggtggcacatacctgtaatcccagctactagggaggctgaggcagaagaatctcttgagcccgggaggcggaggttgtggtgagccaagatcatgccaccagtctgggcaacaagagctaaactccgtctcaaaaaaaaaaaaaaaaaaacatgttcagcaaggttgaagcatcaaaggttaatagccagaatcatttatcaattgtatttctacacatctgcaagacacaatctgaaaatgaaattagaaaaacaacttcattgggcaacaagagcaaaacttcatctcaaaaaaaaagaaaaaaaaaatagtaatctacaatgtcatttcctgttcaagcttgacttctacctttactttctgatatggttttgccatgtccccccacccacatctcatcatgaattataatccccataatcctgatgtgtcgagggaggggcctagggggaggtgattggatcacgggggcagttatcctcatgctgttcttgtgatattcagtaagtcctcatgagatcttatagggttttgttttgttttgttttttggatggagtcttgctctgtcacccagactgcagtaccatggcgcgatcttggctcactgcagcctctgcctcctgggttccagtgattctcctgcctcagcctcctgagtagctgggattacgggcatgcgccaccacacccagctaatttttgtatttttagtagagacgggatttcactaagttagctaggctggtctcgaactcctgacctcagttgatccacctgctttggcctcccaaagtaccagggttacaagtgtgagccaccaagcccagctgagatctgatggttttacacatgtttgacagttgctccttcacatgttcccactctctgtgcggccaccatgtaagtcggacctggttccccttctgccatgattgtaagtttcctgaagcctacccagccatgcgaaactgtgaatcaattaaacctgtttcctttataaattatccaacctcaggtatttctttatatcagtgtgaaacagactaatgtgctttccgataatcatgcttcaggaattggggaattcagactacctgggatcaaattgtggccccaaccttagcagccatgtgaccttggggaggttacttaccttctccatctcaactccttcagtaaaatctgtaaaatgacattgtttctgagggttaaatgagcatagcacagtgtcaggcacacactacttgccagatgtcgagtattcatctttattgaaataggactgtggtaagccactttatggctctcgattttgtatgagaaaatcatgcttagtgccttgttagtaaaagaaagaaaacctgaaagtccctgccacggaaggaagaaatagcggggagaaaagggagttggtaagtttcagcatttcagagcttggagagggacaagttaggtttccattttatggagaaggaggtggaggcaggatgggtcctaaggtgtcattcaaaacacacagccataactctttattgagagtagcgctagggccccagggattgctgtggtcaagttgcggacaaaaatgaccactcgttggaagacaggagaggagtgtttagttacaaaagcagtcaacaattcaggtgtatctatattcagacagcaaataaaagttgttcaacttggttgctaatgggacccactctactgaggctttgtatagaactcatagaggaagatggcttcaaggaatgaactaccctgtgcttttcttaggactaaaatctcaggaagctggtgatgaatgaaaaccttagtcccactggcactgcacgaggggccaggagagcagcagcatcataagccgcagggtggggcagccaaggcaggggcattctgagctgttggggaggggtggcaggcagggtggggcactgtgagctgtcggggagggcattgtgaagtgtggggtggggcattgtgtgccacatgcctgggctcccacctggggccagtgggcttcagtctgtaggtgactacagaaggaggaggagctccgtctgttctctcttcaggcagttgttgtgtctctcagcacttgttgggttcacaacctattaaataagccggctggtcttcaccctcccagacaagtcaactcaggggaggcagcagggtgcgggccttggccagggccagggccagggccagggccagggctggtgcccggggccgcgctgtgaggtgggcaggcgaggagcgggaagaccatctctgcaagtgcagcatagcctcggcctaggacagcgggagtgcgtggccaaagctgtgagcagaggcacaggtggtggcagacagtagaggcaccccatggggaacatactgacctgtcgtgtgcaccctagcgtcagcctcgagtttgaccagcaacaggggtcggtgtgtccctctgaatctgagatctatgaggcagtagctggggacaggatggcaggagcgcccatggctgctgctgtgcagcctgctgaggtgactgttgaagttggtgaggacctccacatgcaccacgttcgtgaccgggagatgcctgaaggtaaggaggtgataggtgccatctaccctcggtttgcctctggctgctgctgtccccaaggttccctttgaggcatcccccactttgagctcctttctgcttgtagccagcttttccgggggctggccaggaacaaaagctggctctgccttgaattcccaccccttagtctttccccaccaagtccagtcagtttcttttcgcctcccctcccaatcgcccagttcttgctctctcacctcattctcccaggctggcatgggaccatttatttatggctcttgtcgaataagcagcagttgaataaatgagttgataaatttttataaatgattacatcttttttcttttctccctctatacatatagctttggagtttaacctttctgccaatccagaggcaagcacaatattccagaggaactctcaaacagatggtgagacaacagtgtctgtagctctgtttattatcctgtgggactttgtttaggcttctttgagctattctcttccttttctcaataaaaactcaaatatcccaacttttcagtacccatcttattttttctttgtacctatccagatggtacctaagtgaaggaaccaggtaagtgcctaattgtttcctttgttaaagtagtcaaatctcaggacagttcctattcaaatatttggggatttcttatttaaaatcagaatggagtttgccacgggagaggctatatggtattcttaatgggctgctttaagtcaccttgatagaagctgcttagtttcttctaactgtaatttgaacacagaaggaaaaagaaaaaaggagagtgcttaaaataattgtgaaaggtgtgaaatgtcacagccggggctgcagaaaaatggttgtgtgtgtgtgtttggggtttctcaaaggagtttacctatgaggctctgattactttaaaattcttactttaacagaaaatgtgtctccagatttattctggtgacttaacagactttatttacctccttgttctaaaagagaggtggggattggttcatggtcaaaactttcaaaagacatgaaacgtcaatgtagactttcaatgtgtaatataaagattgcaggttaaaatgtcagaccttccctgtaagagtgtttgttgccatggctccccctttgtcccttcccctcctgacaatagcatcttgttcaaagataagaaagttacagttttggctgggcttggtggctcacgcctgtaatcccagcactttgggaggccgtggcaggcggatcacctgaggtcaggagttccagaccagcctggccaacatggtgaaacgctgtctctactaaaaaaaaaatacaaaaattagctgggcgtagtggcacatgactgtagttccagctactcacaaggctgaggcaggagaattgcttggacctgggaggtggaggttgcagtgagcagagatcacgccaatgcactccagcctgggtgacagagcgagactccgtctcacaaaaaaaaaaaaggaaagaaagttggagttttttagtctctacactgctggcagaggcaggggatgggagccggtagaaaagagaaaacaattagttggtttgcctctaaaattttgcaaagagatgaatctaagtaaaagtaattctgggtaataatatggttcttgaataaaaactgaaattttcaaaatagaaaacattgcatcataaacatattacatccagtaggcttattggtttcatttaaatgccagagatttcatcactgtagaggaaatgtcttatagctcttctatttaaactttggttgcgctcttaatttttaaagaggtaggataattaagactcattatgagtgtgactttgtaacttggaagtactatcttcacatttcaagatatttaaggattgctttagaataaacaaatgtattatgtgaattaattgattgtacctttatacacaaagcatgtaagtacttgtgtaaacttatactctgcttggtgatgttcggaaagcctgatggatgttacacaccagttagtagatgggtagtgttggatgagagcccaaaaatggctctttattgtcattctttaggattacaacacagtttatgtatgtctcacttggccctttccaatacaaataaggcctgtgtatgttctccctatgtgttgctaatgaagaaatgaaaacttagagatatcacatgactatggaagacagctactcaagagaactaaggttctgtgtcctcagaatgaaatggaagtgacagatatgatgaatttactttttaaaaattttaaaaactctagaatacctcttatattttgcctataaaatagacctgtcttttaaaacttactgccatcttgatttattttatgcaaagttgattttacacaactcaaagccaaaatttacctcttcttttttttttttttttaaataaaggagggtgtcattatgttactcatgctggcctcaacttcctgacctgggttcaagtgattttcccatctcagcctcctgagtagctgggactacaagcatgtgccatcttgcctggctctgtcttgtgtctatacgctcatttcaatggataagaatcaaagtagagatagtgaaatagcctaaatgcagcagccgaataaacgagttgataaatttttatcaatgattacatctttttttcttttcttcctctatgcatatagctttggagtttaacccttctgccaatccagaggcaagcacaatattccagaggaactctcaaacagatggtgagacgacattgttttttccgccaagagaaagaataaaagctcttgtttgatcaggttatagaaagtatttagaaaaactcatattggtttaaaattttcatcttttcacatgttcccttgtcttattttaatatgtgatatactttcctttagttgttatgatgttagtgaaaacgtgtaacctttttgtttatacattttgccatctttttatcaacacaattaatttgtgatgtgatggaggagtcatggatttctctttataattcttggatttatctttatttataattaatggatttatctttatttataatcccttttcccttgctccaaaaagtacattttaaagatgaatgatagaacttaggcttcagcttggttttcatttaaacaaattaaaaaacgtagttgtttatcatcagggattgaatctgtgatttgggcctcctcttacacagtcctctgaccacattcatttaccacatccaagttcatgctactcaaaagttttaggttattaactttttcatttgatataatgtaaatttaaacatgccttactcctgcttatttcccttaatgttatgttaaatcctcatttatttgccaacaagccatacacagccaagttttccagttgacttaaacagcaagaacacaagtgagggttctataataatgtgcgaagtaatgcagcacagtaaaacacgggagtttgtaacctttgtttttatagtttgagtagactttgcccatcttgagtcagttatttctggttagaatttgtcttcattttttacattactataaagagatacctaaggctgggtgatttataacaaaaagaggtttaattggctcaaagattttcaggctgtacaaacatggctttaacatctgcttctggtgagggcctcagcaaacttacaatcatgataaaaggcaaaggggaagcaggtggttccacaccgtgaaagagggaggagagaggggaagggggaaggtaccacactctttttttttttttttttgaaatggagtctcactctgttgcccaggctggagtgcaatggcacgatcttggctcactacaacctccatctcccaggttcaagcaattctcctgcctcagcctcccgagtagttgggactatagttgggcaccataacacctagctaatttctgtatttttggtagagacagggtttcaccatgttggccaggctggtctgaaactcctgacctcaagtgatctacccgcttcagcctcccaaagtgctgggattacaggcttcagccaccgcacctggccagtaccacagtcttttaaattaccataatgagaatgtgcttattaccatggggatgggaccaagccattcataaggaatccactgccattacccaaacgcctcccactaggccctgtctccaacattaagggtcacatgttaacatgagacttggaggggcaacatatccaaaacatatcagaattgtatttcccagttccttccagaggcatgggcttctcacacctagagagcatggaagcagtaaaagaaaagctattccatgtccctcactcttcagtggtagtaacttttgcctacaaggccctcccagcatcaaaggcagaggcagtgtaggaaacaaagcatggcccaagtccctcttggggcttttattattctggcctctttttagggaaaaaaaaatgattttttgtgctgcagacaccatgtccaattaggtttgtatacttattttaacatcaaaatttaggccaggctctgtggcttacacctgtaatcccaactctttgggaggttgaggtgggtggatcacgaggttaggagatcaagaccatcctggttaacacagtgtaactctgtctctactaaaaatacaaaaaacaattagctaggcatggtggcacgtgcctgtggtcccagctagtccggaggctaaggctgaagaattgcttgaacctgggaggcagaggttgcagtgcgctgagatcccgccactgcactcgagcctaggtgacagagtgagactccatctcaaaaaagaaaacaaatttaagataggttactttccagttgtgtaaagaccattttttaattttgttttgtttttagtgacatattagtagataaccactaagtgtggttcaagatgcttacagggtttctgttgcatctagagataggtgtctggtcaggaagtagtttttagaactgttagctcttagagtctgataattaaagtaagctatgtgtaaatgcagaatgagagaatactaatggatcatggctcatatatgcaacagttaaactttttattagctaaatttttcatctggcctaatttttttgcccttttcttttgtacatgaggattctttcatttgtatgtaatagaaacaaaaagtaaactaaatgaaaatctaagtttttagatttgacttatgaaattaatcatgccagataatttaaattatatgttattgaaaattttttttaatggaattttgtctcatttttcataggagtaatcagtaagatgttaacaactacttttattttatggtatttgtatcagaagtgaccagtttttttttttttattcttagttgtagaaataagaagaagcaactgtacaaaccatgtaagtaaacactcaaatagttaagaaattgatagtttgacataaatggatgtctctcttgatttctttaaattacaatgtggacctggtggtggtagcatggacctctttttgtggattttctaaatctcttctattttcctgagtattaaatttatccaggaaagtgcttagtttagcgtgtccaccttttaaagatttctgacatttaagttaaatttcaatagtccggttcaaaagatctgccttaaggctgggcatggtggctaatgtctgtaatcacaacactttaggaggccgaggcaggctgatcatctgaggtcaggagtttgagacaaccctgaccaacatggtgaaattctgtatctactaaaaatacaaaagtagctgggcgtggtggtgcatgcctgtaatctcagctactcaggaggctgaggcaggagaatcacttgaacccaggaggcggaggttgcagtgagccaagatcgcgccattgcactccagcctggacgacagagcgaaactctgtctcaaaaaaaaaaaaaaaattgccttaaatatttaatcttatttttaatgaaagaacaaaaatagaatagctaagttaattgccagcactgtctattgactttctgtcacagcaggtaaaagcataccttccccgctacaccatgatcttatgtttctccctgtgttttttccaattgtagcacactttttaattaaatcagtaatatttacatgattatgactctgcaaatattattcactgctaagtcatatggtgttttcactgtgcctctgcattccatgtccttcatcctgtctctgaaacagttctgaaatctgagcacttctgcaattctcctggatcttcttttttcctagcctacgttagtttatctatccaaatatcgttaagtagcctctgggtgctctgtttgctttcacatccattattttttagcatgaagctaattttctgactatattcatttgcctgttttctaacagctgttttcccccaagtattgtagcatttatcacatgcctttcaaagatattttccatctgcgaaaacacatctgttcctttttatgtttgtgtggggggcaactttctttggccttttgtcatcctagttcaatatagcgtgggtttccctagatatgctcaatgtctgcttttctgggctaactctttaaagtcttttggtatctcacgtaactgctgtcttgtgtgggatcgcctgagtcctagattctgtgtttccttctgtcctgttatcgtctctagttgtacttgaacacattttcctgtgtggagatgttaaaatccctcctctttgatagagagtacacctctaggttgaatctaaatgttgtggttctgaagacattttgcagttgtgctcttattacagtgttgttcttgaatctattgccagtgtgtgatacgttatttacaaccaggttttagttatctgcggaagctttttggaatctctctctctaaggttctgaaattttataacagcttgttggggatcttttcattttattgaggctactaaacctgcagactatctcttcttgagaatttttttttattttctctgttacttttttactgatagtcttgttattcagatgctaggctgcttagaccaatacgcctgcattgatttttaattttttcccttgtatttttttcagtttgtctttttattctagttctgggatattctgtgactttatcctctactatttctattgaattttatattttttgagagtgttttaagatttttttttaaagttttgctcctgattttgactggtcctatcaattccttttttctattgttttgatctcttttcttggaggcttccctccaatgtgtggtggtccctggcctgctttatttggaagcaggatttctgttaactgatagcactcagtgtgaggccttagaagcctgactagcttttcatttgggagacctcagtgtattatctggggatctttattgaagacatttcagtttcttctgagaaggatctcccaattttctgcctggaaagtaaaagcaggcctggaaaggaaaagcagagttagcgaagaaagttggagttccatttttggtgtacagttttctttatatctcaggtttaagccatggtatctctgagccagaaattctcaggtttgatatatccagagaacacacatctaagtttcttgtcagatggaaggacaggtggacttggggctctagttagagatttgcaactgaacttgctggctttttttttttttttcacattttaccctactttccaaagtgccatttgcctgtaagttcacaacctgcctttagttctgcaagacaaactggctcgcttctgttccagtcactttctgtaggcaccaaagttgtgtttctgtgttatttaccactcctttatctactttttatgtctcagcatttattagaaattatctctgtcaaccttctgtgctggtcatgggtgtaacctttattttatgactgatgaggcttccggagggagacgaaataaatttgtggtcaatctattatatttaatccaaatttaggacctgtgtttaaatcaaagtctaatttgagtataattaatgatattaagccagagaattttttaaattaatgtatctataataagcatattacacttttctcctaaggccttgtttaatattttcattcaaagtttatccactgccatatacttcccattacttcacaacatagatggagctgttttcctgaatgcccaaaatgttagaaatatttaagttaattaagatttgttcatttttagcctggtcaacatagcaagacctcatgtctacaaaaaggttaaataaaaaattagccaggcctggtggcatgcacctttcgtattacctactcaggaggttgaggcagaggatcgcttgagctcaggagtttgaggctgcagttaactataattgcaccactgcactccagcctgggcaacaaagggagaccctgtctcggaaaaaggaaaaaagttactaattctttaaaaacctatctaaaatttgtcctgcccaaaaggagagtgaaaaatatgaactttagtctttgttttattttatgtttgctgagaaaaatgctgtactttatttatttatttattatttccataggtttctgggggaacaggtggcatttggtgacatgactaagttctttagtgatgatttgtgagatttaggtgcacccatcacctgagcagtatccgctgaacccaatttgtagtcttttatccctcaccctcctcccagcctttccccgaagtccccaaagtccattgtatcattcttatggctttgcatcctcatagctcagctcccacgtatgaaagagaacatgatatttggttttccatgctgagttatttcacttagaataatagtcttacttccatccaggttgctgggaatgccatgaattcattccttattatggctgaggtggtattcctcatatatatatatatgtatgtatatcacggtttctttatccactcattgattgacgggcatttgggctggttccatatttttgtaattgtaatttgtttgagttcctcatagattctggataatagccctttgtcagatgtatagactgtgaagatttcctcccactctgtggttgtctgtatactctgctgattgttccttttcctgtgcagaagctctttagttaagtctcacctatttgtttctgttgcatttgcttttgtgttcttggtcatgaagtctttgcctaagccagcgtctagatgggtttttccaatgttatcttctagaacttttatggtttcaggtcatagatttatgtccttgatccatcttgagttgatttttgtgtaagctgagagttgaggatccagtttcattctcccacatgtggcttgccaattatcccagcaccatttgttgaatagggtttactttcttcactttatgttttaggtggctttgttgaaaatcagttggctataggtatttgagtttatttctgggttctctattctgttccattggtgtatgtgcctatttttatatcagtaccatgctattttggcgactatggccttatagtatagtttgaaatcaggtaatgtcatgcctccagatttgttgtttttgcttagttttgttttggctatgccggttcttgtttggtccatataaatttcaggattgttttttctagttctgtgaagaaggatggtggtattttgatgggagttgcattgaatttgtagattgcttttggcagtatggtcattttcacaatattcattctacccattcatgagcatggggtgtctttccatttgtttgtgtccatgacttcattcagcaacgttttgtagttcccaacggcatatcaaaaaataatcgggccaggcacagtggctcacacctgtaatcccagcactttgggacgctgaggcggacggatcatgaggtcaggagttcgagaccagcctggccaacatggtgaaatcccatctctactaaaaatacaaaagttagccgggtgtggtggcgctcacctgtaatcccatctactcaggtggctgaggcaggagaatcgcttgaacctcggaggcagaggttgcagtgagccaagatcaccgcactgcatattccagcctgggcaacagagcgagactccatctcaaaaaaaaaaaaaaagataatccaccatgatcaaatgggtttcataccagggatgcagggatggattaacatacacaagtcaataaatgtgatacaccacataaacagaattaaaaacaaaaaatcacatgatcatctaaacagatgcagaaaaagcatttgacaaaatgcagcatccttttatgattaaaaccctcagcaaaatcagcatacaagggtcacagctcaatataataaaagccatctatgacaaacccacaaccaacatgatactgaaagggggaaaagttgaaagcattccccccgagaactggaacaagacaaggatgcccactctcaccacttgtattcaacatactactggaaggcctagccagagcaatcacacaagagaaaacaataaaaggcatgcagatcagtaaagaggaagtcaaactgttgctgtttgatgatgatatgatcatatacctaggaaaccctaaagactcctccaaaaagctcctagaactgataaatgaattcagcaaagtttcaggagacaaaattaatgtacacaaatcagtagcgctgttataccccagaagagaccaagcttagaatcaaaccaagaactcaaccccttttctgatagctgcaaaactaaactaaactaaaataaaatacttgggaatagacctaaccaaggaggtgaaagatgtctacaaggaaaacaactttagtatttttaatgggttaaaatgagaggcagcaggtacagcagaagaagtcagtgcgtgggcatccgcatccaatgggtactgcacctttgatggtaaggctttggttttgacttactaaattactaggtacgattattttctagtttttgtcattaaaccttaaaactactaagtaaccccttccatttcttgttaaatattgtaaaatttcatactctcatttatgctgcctgatgttagagtatttgtttctattttgtgactaccttaaataatacctataaagagtaaactgttagtagtgtttttgctgtaattaaatgtagtaagacttaccttccaaatgataactgaattgtcaaacacttgtcgaagttttggatttactcaaaattctatgctcagcagctggaggtaggaagagtaagggccctcccttactcttatggagaggcatactttctcacaaggggaatactctgcaggaattagcatcttgtaagcagtggtgaattcaactaattagtgtataaaaatacattttttggtgtggctgccgacaaagagatccaagagggtagatggagtcgagcttgctgaagcaaggaaagagaaaagcagtattctaggcagagagcaggggtagagcaggaaaatggctaggtgcaggtcagatgatttatagaatgcaattgatcaagttttgaagtgaatgcaaagtattctccgagagtctcatttgagtcatgtcttggcagtcttatttaaacatgaagtgaaagttagattttttaagttgtcatttgttttcagggtgtgagagaatatgtaagtgatactctttttatcctccacataagaaaataggactagagaaacctatggcttcctcacttgttggtggcctagcagccctggcacacagagcctctgaatctgaaacacttcttttgtaacaatatcacctgaaataatacatttaggattagtaatttagtaaatgcattagtcttgtattcactgcaataaaatgctcttgtagcaggattatttaatacattacattttattgtagtaaataaataatagaagggctgggcgccatggctcacgcctgtaatcccagtactttgggaggctgaggcaggcagatcgcgaggtgaggagatcgaggccatcctggctaacacggtgaaaccccgtctctactaaaaatacaaaaagttagccgggcacggtggtgggcgcctgtagtcccagctactcaggaggctgagtcaggagaatggcgtgaacccgggaggcggagcttgcagtgagccgagatcgcgccactgcactccagcttgggcgacagagcgagactccgtctcaaaaataaataaataaattaattaattaatagaaattctcagctgctttttattgctgcagaaaaaaaatgaaatcttattttaaacttttctttttttttttttttttttttttttttttgagacggagtctcactttgtctgccggcctggagtgcagtggcgcgaactcggctcactgcaagctccgcctcctgggttcaccccattctcctgtttcagcctctcaagtagctgggactacaggggcctgctaccacgcccggctaattttttgtatttttagtaaagacggggtttcaccatgttagccaggatggtctcgatctcttgacctcgtgatccgcccgcctccacctcccaaagtgctaggattacaggtgtgagccaccgcgccccgcgaagccgacttttcccattatttttaacggtaattcataaaatccttgttaggtttgatgacaggtaccatattaagggcagcattttataacccatatcttaaacatcatctctggaagttgagagcctccaatgggttttctatagagtgcacatgataccacactcaggcagttcatggagtgtaagacatatcttagtgctttgtcatttgacattttaactgagaaaataatacactttgataagtttgacttacacttcccttccccttcaggtatctactgtgcgtttcagtcaacaatacagcttgtgttcgacaatattccttgatgacagcacagccatcagcattatcttacaatgacaataatatcgtgagtacaactatgctgccgagggacagattcctttattctaaaattatttcagtcatttggttgtccttttcagcaatcagtttaagaaattggagtcaaccatatattgatatccagattctgaatattaagtatcagtttctcttttaatcttagacgtcgtggtggaaggaaaaatcagttagcaaagaagcaatcccagaaacagtgtatctttttgatgcctttatgcctttagacaatgttgaacagagtgagaaggataggttccctttattgaatgttttcttgtggaaacttagtttttcaatgcatcataggcctaaatcagtgtgcactactttggacattatccttggaagaaggaacagcttttcttcttctggcaacgcagtgtatctgcatttgaatttctcccattgtgcatgagcacctcatgggccacaaagatgcgctttgagagcaccctgagatgaagtttattttaaaaggaacaacaaccaacaccaccaccagctccacaggggctgtccagtgtacattattctcatcttcttgggttattagtcttgatttttagaacacagtttggaaagtgctaatttagaatattaatgtctttatctttaatttaacttttcattctgtacacataactagcttataaacaattttgtttcaaatgcactagcctttttaactaattcaattgtcaataacttttacttcaattaaaagtggaaagtttacactcataataatgtcactttcctccctcccttttaacaatagttgagaggaaattgtgtttcgaacaaaaactggactcaaactctgtctcaagtcctgagctttgggacctattgagtaatcactaaatgtctgtagtcagctaagtctcttaaatctctgagcacacatacacaaaaattactttgactagagtccctggcttcttctgagttccaaagattttcatatgttagcatataattcaaaagcagctttgaagattaattttgctgaaacaaatttcgtgcttttttcctcattattctactttttagaagtctacttttgagagtatagtaagttttaatttgccaccagcaaatttgagaaatgatcatttggtgtattcactattggtgaaataaagttattgaacaaattaattgggcaaattggcttcaagaagatattttgaaaaatgttttatcatgaatcagtagtgcactgttgtcagtgggataggtggaactcgctgagatcacttatgcaaggtttttttcaaaacacaagtctgcaaacacatgtatcttcccatctccactttccctctatctctaggcactgagaagccttttaggaaaatcgggatggatgtgaggcatctttctgtgaagaaaagcatcccagaagattctgattttcaccccaactcaatcattccaaactttgctgctgattgaaatcacctgggaaacgtttaccaagaaccttgatgcccaaagccatacccaatactaattaaattaaaatgtctcatgtggaagatgaggcagatattaaagcttctcaggcgattttaatgtgcagcaaagtttgacagccactgcttaatttgagtttaggatgagaaactgctcctatttggtgggaccttgggcaagtcagttttaaggtctgtttccctgatctgtaaaacgagtgttgaattaaatgtcacataaggtcattggtcctttccagcatgtaactttaaattctgtgattttaaaattatttcagagatgaaaactacttgaagcactatagacatatccatcttacctgctaatgttacaggctttttaaaaagtgctaatattgtgtagacctattagtagaattgagatttgccttccctcagttgttttgaggctcactctacaaaattagctgggtgtggtggcacatgcctgtaatcccagccacttgggaggctgaggcaggagaatctcttgaacccgggaggcagaggttgtggtgagccgagatcacaccattgcactccagcctgggcaacaagagcgaaactccacccaccgcccccctccaaaaaaaaattatctgggcatagtgacacaaacttgtagtcccagcttcttgggaggctgaggcatgagaatcgcttgaacctgggtggtggaggttgtgaggagtcaagatggcaccactgcagtccagtctgagcaagagagacagactctgggtcaaaaaataaataaatacataaaataaatcgcatgggacgaaaggtttcgtgggtagaaaagcatgtaacaaggaaatctgttattatttatatattgtaatcaccaacagaaacgcgtcttctaacggcatatttccttgcattttggttctcatatttttgtaaaaaacaaagaaatgaaaacaaagtgcccttatggtactgttctgaactagaagatttgaatttcagggccactaggagagtttcctctgccccccttttaaaaaatgtcttcaggcctaacaaatgttaacatctattgttatgaattttttttccttccacagtgtgaccttggagatacctcatcatatcacacaaaggtgagctttttagaaacctgtcttgttattctagctaagtactttgcaagatatcaagctcagtgttaggcacatcataagctgtattgtgcctactaaaatattgaagcaaattatttgtattttctttgttccttaagactctcataattcttaaatgattgagaatctcaaagagtatgtgtttatattgattatattgatatttagtgtggtagaattatacaattgaaattttttcaaaatctatttttagtttagatttcacagccttaccactgttgatattatgggctagataatgctttgttgtgaggactgtcttgtgcattgcagagagtttagcagtattcatggcctctaccaactagatatcagtagtaacccatgacccaggttataacaacagaaaatattccttgagaacagtattgttaacagaattttttcattgaaaaataacttttctacaacaaaaagttgagtaaaaagtgcgtcatgtatttatattatttaaagtctctcatgttgagcttaataggagacaaatggattctctagagctttctttgcaatttgctttaaagcagcaataagaggttgggcacggtgtctcacgcctgtaatcccagcactttgggaggctgaggcgggcggatcacaaggtcaggagatcgagaccatcctggctaacacagcgaaaccccgtctctactaaaaatacaaaaacttggctgggcatgatggcacacacctgtagtcccacctattctggaggctgaggcaggagaaccgcttgaacttgggaggcggaggttgcagagagctgagatggtgctattgcactgcagcctgggtgacagagcaagactctgcctaaacaaacaaacaaaaaaagcaataagctggtggggcgcagtggttcacacctgtaatcccagcattttgggaggccgaggtgggtggatcacttgaggtcaggagtttgagaccagcccgaccaacatggtaaaacccgcctctactgaaagtacaaaaaatggctgggcgtggtggtgcatgcctgtagtcccagttacttgggaggctgaggcaggagaatcgcttgagcctgggaggtggaggttgcagtgagccgagatctcgccattgcaccccagcctgggtgacagagagagactctgtctcaaaaaaagaaaaaaagaagcaataagatgaccgaacctcatgcaaatatgtagttggtagaaggtgtatttttaaacttttcagacagttgtgggtatttgttaacactaaatcaaaacttcacaagtggtggtttcttaaattagttacggtggcattttacatattaataaatttattccatcagtactcattgatctttcttccacagtaaatggatcttttgctccatacttgcatttataatatcatgcattagttacttggaatatatcggtttatgttttattgtgtcaaaaatcacttttagtttaaccaccaatcttactttaacacgcctttaagtattgaatagctgccaagcctacagtagaaggaacaagtttttcaaagtccacaggaaagcttaaattttatcattgggaacaaatacgtatttcccttgaagtgacaacctctcacttcatttatttttgagaatgatagttgaactggttttttagaccgagtttcactctgtcacttggctggagtgcattggcatgatctcagctcaagcaatcctctcacctcaggctcctttgtagctggcaccacagatgtgtggcaccacgccaggctaattttcttatatgtttgacagtgacagggtttcgttatgttgcctaggctggtctcgaactcctgaaggagctcaagccatctgcctgctttggtctctcaaagtgctgggattttacaggcgtgagccactgcgctggcccagttgtacttttaaataaaaatgatgttctgtgaaaaaagtgatttttcagttcatagttaaatcacggattctttaaaaacaaaaaaaaaagcgcttctggttaactttccacttattcagaatattagagacatgtcaagatttaacaacattaatttttactgcttcatcaaagacattcttaagaaattcaggctatgttttttacctgtaggggacagtgaagaatagaatgactactaatgtaattggtaccactgccttgatttatgctgagaaaccagccattgtacccacttttgcttttatataatcatggcaagtgtcaacgaaagagcaggcaatggctttgtattactttcacaaatttttaaaatttttcatcagctttctcaggtttaattagtatgattcagaacagtgttggccaggcacagtggctcaggcctgtaatcccagcactttgggaggccgaggcaagcggatcacctgaggttaggagttcaagaccagcctggccaacatggtgaaaccacatctctactaaaaatacaaaacttagccaggagtggtggcaggtgcctgtaatccctgctacttgggaggctggggtaggagaatcacttgaacctgggaggcgaaggttgccatgagccgagatcacaccattgcactccagcctgggcaacaagagtaaaacttggtctcaaaaaaaaaaaaaaaaaagaacagttatgacctcttaggccttctggaaggggtcttcgggatcccgagaggtccacacagcacatttggagaaccactggtttatacacaggcacaatgcattagttttacaaagtttaaagttcatcaaagactggcgtcttaaaaaggcagatgagtttgtcattcaaacaacagaaagtacataaatacatcatgagagtatactacagagaactaaagagaaaggaagctaggaaatctgaatcacatttacatttattaaagtttactactactgctttgtagaacattcttgtgtttcaatgtgtggttagaagagtgaaaatatgtttggtttattgccatggcctgttagggagagtcaatactcacgggcatttctgactggttatcatataaaagacttcacggtacaggccatgatgtgctgagaaagaagaagtcaggaaaccctctgcaagtcaggatccaggagaagaattcgtaaaaactgctttggtaaacaccaaagcacacaggaggcagtattttactaaacaaatattatactaagatattaacagtttttgaagtaacgcgctttcttattttatagagatgcagatagatctttgagcatacctgatgaacagttacactcatttgcggtaagtggcacttttattgaggttgtattttcatcgtacacttgtatctgtttcatgctgaagtcaaagccatctttttttaaatcttccccatttcatgttgcatttagtcatcttaagtgttgtaaaaagaatgtgctggagtaagaactgatctgcagctctgtttagttagtgagctagtatgagtaaatatactatccaaacaacagaaaatgtatctttttttttttttttttttttttttatggactctctttctgtagcccaggctggagtgcaatcgcgcgatcttggctcactgcaggctctgcctcccaggtccctgttcaagcaattctcctgcctcagcctcttgagtaactggaattacaggcatgtgccaccatgcccagctaatttttttttctttttttttttttgtaaagacagggtttcaccatgttggccaggatggtcttgaactcctgacctcgtgatccacccacgttggcctcccaaagtgctgtgattacaggtgtgagccaccatgcctggcccagaaaatgtatctttttaaaaggtaattgtgagctgtctataggaccctgcaagccactacccaatttttgaagccattcctccttctgttccacacaggtttccaccgtgcacattacgaagaacagaaatggaggtgggagtttaaataactattcctcctccattccatcgactcccagcaccagccaggaggaccctcagttcagtgttcctcccactgccaacacacccacccccgtttgcaagcggtccatgcgctggtccaacctgtttacatctgagaaagggagtgacccagacaaagagaggaaagccccggagaatcatgctgacaccatcgggagcggcagagccatccccattaaacagggcatgctcttaaagcgaagtgggaaatggctgaagacatggaaaaagaaatacgtcaccctgtgttccaatggcgtgctcacctattattcaagcttaggtgattatatgaagaatattcataaaaaagagattgaccttcagacatctaccatcaaagtcccaggaaagtggccatccctagccacatcggcctgcgcacccatctccagctctaaaagcaatgacctatccaaggacatggacaccgggctgggtgactccatatgcttcagccccagtatctccagcaccaccggccccaagctcaacccgcccccctctcctcatgccaataaaaagaaacacctaaagaagaaaagcaccaacaactttatgattgtgtctgccactggccaaacgtggcactttgaagccacgacatatgaggagcgggatgcctgggtccaagccatccagagccagatcctggccagcctgcagtcatgcgagagcagtaaaagcaagtcccagctgaccagccagagcgaggccatggccctgcagtcgatccaaaacatgcgtgggaacgcccactgtgtggactgtgagacccagaatcctaagtgggccagtttgaacttgggagtcctcatgtgtattgaatgctcaggtatccaccgcagtcttggcacccgcctttcccgtgtgcgatctctggagctggatgactggccagttgagctcaggaaggttatgtcatctattggcaatgacctagccaacagcatctgggaagggagcagccagggacagacaaaaccctcagaaaagtccacgagggaagaaaaggaacggtggatcctttccaaatatgaggagaagctctttctggccccactaccctgcactgatctgtccctgggccagcagctgctgcgggccaccgctgatgaggacctgcagacagccatcctgctgctggcacatggctcccgtgaggaggtgaacgagacctgtggggagggagacggctgcacggcgctccatctggcctgccgcaaggggaatgtggtcctggcgcagctcctgatctggtacggggtggacgtcatggcccgagatgcccacgggaacacagcgctgacctacgcccggcaggcctccagccaggagtgcatcaacgtgcttctgcagtacggctgccccgacgagtgcgtgtagttctgttttatttgactacagtctccttggtgcaaaaacaaaatgggaaaaataaggataactcagaatttcaaaaggaaatcacaaattcagcttataatagcattttcagtacttctcataaactaagtaaatacacaaaatgttgatttttctgaccataagacatattttatgtccttttgccgaggtggatgtgttagtctcaggccctcctggccacattgcccaagtcacacaggcttctgtattatgtatttagataagatgtgtgaaaatatatttgaaaaaaagttcataaatttgcattgatttttgtacacatggcacctctttttcattttttttttttttttggacgatgttttgctctgtggccccagctggagttcagtggcgtgatatctgctcactgcaagctctgcctcccggattcacaccattctcctgcctcagcctctcaggtagctgggactacaggtgcctgccaccacacctggctaattttttgtatttttagtagagacatggtttcaccatgttagccaggatggtctcgaactcctgaccttgtgatccacctgcctcggcctcccaaagtgttgggattacaggcgtgagccaccgtgcccggtccgtggcacctctcttaatttataaattgaactgaatgtgaagtaataatgtcagctagttgagataagagggttacagatcggctgggcgcagtggcccacacctgtaatcctagcactttgggaggcctaggcggactgatcaccaggtcaggagattgagaccatcctggctaacatcatgaaaccccatctctactaaaaaatacaaaaaattagctgggcatggccgggcgtggtggctcacacctgtaatcccaccactttgggaggccgaggcaggcggatcacaaggtcaggagatcaagaccatcctggctaacatggtgaaaccccgtctctgctaaaaatacaaaaaaaaaaaaattagccaggtgtggtggcgggcacctgtagtcccagctacttgggaggctgaggcaggagaatggcgtgaacccaggaggcggagcttgcaatgagctgagattgcaccactgcactccagcctgggtgaccaagcgagactccatctcaaaaaaaaaaaaattagctgggcatggtggcgggcacctgtagtcccagctacttgggaggctgaggcaggagaatggcatgaactcaggaggcaaagcttgcagtgagcagagattgtgccactgcactccagcctgggcaacagagcgagactcggtctcaaaaaaaagaaaagaaaaagagggttacagatcattgcacatggaaaatattcccagcagtaaacacttccattaatgtgatctacagcttttaaaaaggagcatctcagaataagatggtggtacaatttgcttattgagaaaggaaaaaaaaatacatgagtatattacaaagggaaaagaaggaatgtgatttctcatgattgaaagcttgatttagattgcatacagcttttgctacccaagaccaagcagctctggcaagacagggtggttttccgaatgccagaccgaggtgccttatgaaggcagctgccgatggttccagatgtagagagataggtgatgcaggagggaaagctggattggaaaagggagagttttgtagacgggctatgctcattgtgcctttgaaagagcagagctggcagcctgtagtcatcatttggatatacaggactagagcatgaatctgatgtagagctacagaatgaagagcaacagcagctgtttaaataccgagaaagtgtgtagaatgaaattggacgagccaagcatggtggtttcatgcctttagtcctagctactttggaggctgaggtggggaattacttgagctcagcagtttgagtccagcctgggccagatggtgagaccctgtatcttaagaaaagaagaaataagaccaggtacagtaagtatctcatgcctgtaatcccagcactttgggaggccaagttgagaggactgctcgagtgtaggacttcaagaccagactgggcaataaagtgagacccatttctaccaaaaaaaaatcaagaaattagctggacatggtggcacatgcctgtggccccagttacatggcatggcaggctgaggcaggaagatcacttgagcccaggaggtggaggctgcagtgacccatattcatgccactgcactccagcctaggcaacagagtgagaccctctctcaaaaacagataaagtggacagaaaataggtcggtaaggactaatcatttaagggacaagcccccagaagagtggctactagagtgggaggaggaaaagcagaaggagaaagagttgaagataggcgaggctgtggtcccagtgctgaattctgccaagcagtgacttgattcatgaacactcactggatgctgactctgttgctcttctgagtgctggggtagaggagaggagaggtggagcacagttcttgcttttatgagcttatgttctaggaagttcaaacaagtattttttcaggtagtatgaaatagcaggaagaggaagcaggctaaagggacacagagtgattgggggctattttaagtagaatgataaggaagagcctgtctagagagctatttgaacagtgacctgactgaagggacaacagaaagcagtgctgacattacaggtagcaggatgactgccaagacagaaacgcatttcatatgtgttcgaggaacaaacagcaaggtgaccagcatggggagagtgaagaatgagggaaaccttgaatgagaataaagcaattccatcttggatgctaatctgcaatattctgattaatcccagttccaacaattcatctacgatttctattttatctttttaaaaaaattattttttattttttattttttgagaccgagtctcactctgtctcccaggttggacttcagtggcacaatctcagctcactgcaaacttcacctcctgggttcaagcgattctcctgcctcagcttcccgagtaactgggattacaggcgcctgccaccacgcctggctaatttttgtatttttagtagagacgaggttttaccgtgttggccaggctggtctggaactcctgacctcaggtgatccgcccaccttggcctcccaaagagctgggattgcaggcgtgagccaccgtgtctggccatacacatccctgctgaagcccgcattacccttcccctatgctatagaagccctgggtcgggggggtgggggtgatggcacagggatccaccatcttatcttggtgccatccctgacttgccttctgttcataaacgcctattaaatgtttctttctgagaaactggatttgtcagcctctttctttggtatctcaggttccttggcctttgcgggtaggtttatatagacctgctcagcacaggacaggcagtttctcaaaaaattgaaaatagaattaccaaatgatccggcaatatcacttctgggtatatagccaaaataattgaaagcaaggtctcatagaaatatgtgtacactgatatttatagcagtggtattcacactcgtcaaaagatggatgcagccgaattgtccataggcagatgaattgataaaatgtggtatatacatacagtaaaatattcttcagccttaaaaaggaaggaaattctaacacatgctacaacatggatgaacattgaggacattatgctaagtgaaataagccagttagaaaaagacaaatactgtgttctttcacttatgtgaagcgtccagactgagtaagcaaactaatagaaacagaaggtagaacgggggttgccagggacatggggaagggagaaaatgggaagttgcttagtggatatagagttttggttttgtcagatgagaaagttccggagattggttgcatggcaatgtgaatatactctacattacccaacccaagggctctccttgacccctgttccaactgccacttagaagtggttaaggtagtaaattttatgtatattttaccacaattcaaaatagaattattattattttttttattataattttttgagatccctcactctgttgcccaggctggagtgcaatggcaccatctcggctcactgcaacctctgccttctgggttcaagcgattctcctgcctcagcctcccaagtagctggaacttacaggcacatgccaccatgccaaactaatttttgtatgtttagtagagacagggtttcaccatgtttgccaggctggtctcgaactcctgacctcaggtgatccacctgccttggcctcccaaagtgctgggattacaggtgtaagccaccatgcccagctgtcaaaatagtttttttttgtttttttttttgtttttttttttttttttgagatggagttttgcttttgttggccaggctggagtgcaatggcaggatctcggctcatggcaacctccacctcccgtgttcaagcaattctactgcctcagcctcccgagtagctgggattacaggcatgcaccaccatgcccagctaattttgtattttattttagtatagatggggtttctccatgttggtcaggctggtctccaactcctgacctcaggtgatccacccacctcggcctcccaaagtgctgggattacaggtgtgagccattgtgcctggccttttttttttttttttttttttgtgatggaccttcgctcttgttatccaggctggagtgcaatggcacgatctcagctcactgcagcctctcctcctgggttcaagcgattctctttcatcagcctcctgagtagctgggattacaggcatgcaccaccacgcctggctaattttgtatttttagtaggtatggggtttctccatgttgatcaggctggttttgaactcctgacctcaggtgatccacccgcctcggcttcccaaagtgttaggattacaggcgtgagccactgcgcctggcctgaaaaaaaatttaaaagtttgagaaaatataaaatttttatagtctccatgtatttctcctaagatctttccccctatgaggggaggaaagaggaattattataacacaggaagatgtttaatactcaggattttttatatcatcatatttaaagtctttttctgcacagctaaatctgattccctgctactaaatctgattgagttagcaactaaactaactgatttggtagtatctatccagatcacaaacagaaatattgttaagactccctcaaaaaggagtttaacctcaataggtaactcctcctaactatagttctaaattaatgaaacacagtagtcatttaacaagatactagtatatatggccattggggtatatgggacatgctacctcaaaatatgacaccttggcatttgagaaaacagaagcagaaaggtctctctgacctttccctggcccttctcctctgaagcaggacatagaagaatcctctaaccctctctggagtaggtcataagaacttaattccagtcctccctattcccagaggaaaggagcctccttatttgtaaagatgcagagaatgatctgaccacacaggccttgctgagctcccccagcttattcccttcaggtcacacccctttcatctaatcgtgcttctccaaaactgtccgcttcttcatcagacagcatccaattgacacaggatttcctgtttctcttgagtttttctttctgaaggctcctgtgtctggtaaaacttatcttacgtaaacttgcacacttttctctggttaatctgtcatttgttctaagggactcgaccatgaacctagcgatggctgagaaatcatttcccccctagccggcctaactcatttgaaggagcatacactattgtgtgggagtcatacttattcctaaccattttgaagagattcatctttaaattaatatattacattaaatgtcttccttcagaaaagacaatcttgtgaacatcgcctttggtgactgaacatcacgagatataaaacaggtagaaaaagaaaatatttggggtggctctaactcttaaatcccatgaaataatcccctcttctttagcagaaacctcagctcacctcctcatcactgctgaacaacagggcagatgctttctttttggagagcttggaggcttttgctttctcttgtctttgagcttgtagagacaatgtctgcttcttagcagctgtacccccaaaaagattatcctagaaaagcaaatggcagaaaggtaagacaactttataatcagaaaacataggatgtcctcctatatcaaactttaaggaagtaagtctccagtcaggtatacaaataacaactctggtgaggaaaaaccacaaaatgctagtaaatcccaaactacagccttttctcactgcacccatagaagggaaagagattaccatagaactcgaaggcagaacagctgtgaataagcaggagaacaacatgcgaatgagatcatgaagtacaaggagaaactgagccccatccagtcgccctgtgggcaagtgcctctctgctcatttcaggtggttacagcctgcgatgggcacgggagcccccgcagcagccagaaactcacactgttgtctccacaaatgagaaaccagaacaatggctgaaaggagagaactgggggtctgtctccactcctttacaggtcagaaagacatacacctgggatggagggaaggcatgacttgtgtttctcattagtttcaaagagattatacaaagtggagaaatagcttactaaataaaattgctggtgtactaagtttaatggcatttgtaaattcttctgtggtcaagcactccccaaaagttatatttattaaggtgcttttattcagataaggggaacaaaagcatcagagggcctgagtctgagttaggatggacaaactcttaacagcaggtgaacagccctggaatgtgaagatggatgaagggagtgtcttcctggatgaagtctcctttaaggagagtgcggtaatgtaggacaggccaggagaataatgagctggtgtccattggggatgctaatgacagagctcacattcactatgcacttattatgtgccggcactctgcatgagcttcacactagtagttacagctgccacaatgaccctactcactgttaagccacatgagcttaaggaaggttaagttacttgccccaggttcctggtttgcaagtggtggagctgggatatgaacccaggggtctgatggcaaagcctctgagctcaccaccgcccagtactgcatgagagttaaggtttgggttgtcttctctcttatttctcttccccactgtgctctctccagccaggatgggaaagaaagacaatggtcaggacatggctgccttctcctttgtatctccacttgatccaaaacattcttgtaggtcattgggtatatgttgatccatcctctagactaaagtacagctcaccctgaatgacacaggtttgagctgcacaggtccacttctacacaaatgttttctcagtaatatgctgaaaattttttttggcatttgcaacaatttgaaaaatcttgcagacaaaccacttagcctagaaatatcaaaaaaaaataaggaaatgctagatatgtcaggaatacaaaaatatataaatagatactatactatttataggttaatcaactgtttgtgttacccatgaggcttctggttaacagtaaggtatcagtagataagtttttgggaagtaagaagttatatatggatttttcactgcaatgtggaagccaaaacaacctcctcactgttaaagggtcaattgtatttctcaaaggaagatttctaaaaataaaacctgtagatttcactccataagaactgtgtcaagaggccaggcacggtggctcgtacctgtaatcctagcacctagggaggccgaggcaggcagatcaactgagatcaggaatttgagactagcctggccaacatgatgaaaccctgtctctactaacaatacaaaaattagccgggagtggtggtgcacgcctgtagtctcacctacttgggaggttgaggtagaagaatctcttgaacccggttgcagtgagccaagattgcaccactgcactccagactgggtgacagagaaagactccatctcaaaaaaaaaaaaaaaaaaaaaaaagaactgcgtcaagaatctaatgtcttctccattgcacagctaggaaaatataaggaagaagtcactgaaataaaaacagaaatatttttgttatataaacttcaggtagcctgactgcttccctaccaccttttgctagtatatgagcctctgggtagaaagttacatcaacaaccgttttctcctaatctaaattatctagtgttacaataacaatgtttacctcttcatcttcatcatcaaacagggaaaccgacgtggggagcttgccaggcagcagagacgcaccttttaagttactcgcactttgagaagaaaacaaatcctgttggattgaaattaaaaagttgctggttaacaggaatatcagtttttaaaatatcaggtcagtataaaacacaagtgactcagacatgacagctgccatgtgtctaggcttctttcctgagagggaaggtggctcagacagagtccttaaaggaggcctcagggtctgtgcagggtgtgtgcagtggcgctaaggaggaggagagctacaggatctggtgggctcgcagagcccaggggcttctgtattcccacctgaatgacagaaggcaggaataagtttttgaatcaatttcctacaccatgctaaaaaaataaataaataagaatggcttcccattactgtctaaagaatcagaaattagacagggtcaataaagaaataggagctagattcccaaattaagggacctacaactattttatttcgtaacacccttctttcctaagattatgacttatttctttttcttttttctttctttttttttttgagatggagtctcactttgtcacccaggctggagtgcagtggcgccatgttggctcactgcaagctctgcctcccggattcacaccattctcctgcctcagcctcctgagtagctgggactacaggcgcccgccaccacgcccggctaatttttttatatttttagtagagaccgggtttccccgtgttagccaggatggtctcgatctcctgacctcgtgatccgcccgcctctgcctcccaaagtgctgggattacagacctgagccaccgcgcccagcccacttatttcttttaaataaatacaaattaaatttttatttgtaaatgtttgatagtctacttagttttactacaagtatatgatgttgcaaaccaggataagacctgctagattctgaataaactttcagcctggcactgtggctcatacctataatcccagcattttgggaggctggggcaggtggatcacctgaggtcaggagttcgagaccagcctgggcaacatgacaaaaccctgtctctactaaaaatacaaaattagccaggcgtggaggtgggtgcctgtaatctcagctactcaggaggctgaggcaggagaattgcttgaacccggaaggcggaggttgcagtgagccgagatcccaccattgcactgcagcctgggcaaaaagagtgaaattttgtctcaaaaaagtaaaaaatataaaaataaagaaattttcaaaacgttataagacatcagcttatcctgcaaagaaagacctacaaattgagctacatgaagtagaaacataaaatgggacatctaatcccttgggaagagaaacattaatacacaagagctgaacaattaaataggacaagaacatattttctaagacctcttctgacagtttttttttttttaatcatggggttgatgtctactcctcaaacatagacctaatgagttcactaagtgagatctcctccacacagtgtttttcccctgtgctccccggagtcccatgggtttatttagatagaagaggccacaaggggaattccaggcatcccgtgtccctcctgcatgttacacaatggcaagagaaagggttctgctgttctaagaaaatgaaagtaaaccaaagcaaagaacaaaaacaaatgtcaacatcacagttttggacccttaactaatacttttattggtactgcaaaaaaagacacttccattacctcaaatatgttcccctaaaatgacttcacagggcaagcttcagccccacacttgagatacagagaaaggagtcaggacgcattcctttgggtccaaagctttaactcttacttagactgccttagttttacttctccttgcctcagaatctgaacaatatccaataaaaacattcactctatgatgacacacatgaggcaaagcctttggtagggttttcacacaagtctgagagtacatttacactcccaccatcaagaaggggagcctatggcccctccccatgaacctggatgggccattgtgaccatcttgaccaacaaatgaagcaaaaggaccaccgttgacttccaaggctggaacacagaaggcaacatggcctccactgggctctctctgaggactctcccctacagccctgagccagcatgtaagaggaccggcttccctgactacatgctgggagccacacagggctagtgagagatgtcccaggggccccagtgcccaggtaccagacatatgagtgagctgaccctcagcccagccaccttcagacacaagagaccctcagtgacaacggcctagctaagcccagtcaaactctcgaagtatgagataacaaaactactggtgttataaactactaggttttggagttacttgtttcatagcaacaaataaccagaacatctcgtaagtcactgaaattgctcacatttggttttcttgtctaatcaacaattactggatggcttaccacatgccaagcactggtattaaggacagggtgctggggatacaaacagggaataaaaagtcctgtccttgtggcacttactttagtgggaagtagagacaatgaataagtaaatatacattgtccctggcaacacgtgctgtggtaaacagtgaaataggaaagaggaccaggagcacagcgtggtatgtgctagcaggcttcctgttgtgtgtatttcatcagcgaggcctcacagagaaatcgaagagtgaggaagaaagctggattctgggaacagcattcctcagagtggcaggggccggtgcaaagaccccgaggtgcaggtgtgggtgacacaggggatccatgagcataagacggtggaggccccatcatgctgtttctcaggggtcagggttgtgacttgactggactttggttaattgccatgttttgtacactcgccttcaatgaaataatagcctcaaaggtattctttacgtcaagggcaatcactatacttccaaagggttccatgttcatccttgctgtgagtgcaaagcccaaccatgacagcctaacctagagcccacagtttcttgaaatacatgtaagtttctgccatgtccacatgtttttctgtaaaaggggcttattatttcccattacatttctcatacaggtctccgatctcctaaaaggccaacttaaaattagatctaagacgacctaggcctgagagattcaggaaaagcagtgaaattctgagaggtggttctaaggtacctggagggaccaaagcaacctgtgaaccagggtcccacaggctgttagtggtctcagtctcgacaagacagatggctatgccagaacccatctgctacagcattaagccacggtctagttagtgagaatgtgaataaaggaagtagcatggtgacctccactctggtgcaagctcctcatcacatcatgagcccatgaacagtttacaatctgagcatcctaaaaagagagtattttcatcccaggaaacgtaaatacagtccaacccaaaagtgaaaagtattgtaaacatattgctttctaaaacccctgtgctctcaagagattattttttattcatttatttattttgagacgaagtctcactctgtcgcccaggctggagtgcaatggcgtgatctcggttcattgcaacttctgcctcccgggttcaagtgaatctcctatctcagcctcctgagtaattgggattacaggctcgcaccaccatgcccagctaatttttgtctttttaatagagacagggtttcatcatgttggccagcctggtcttgaactcctgacctcaggtgtccacctgccttggactcccaaagtgctgggattacaggcatgaaccaccgctcctgacctctagagataatttttaaagaactggagtacttaacgaaaagtcttataactctgctgagaaaaacctgattcagaaatagtttctatgtcatatccatagactaatacccacaactaaggaaaagaataccatacctcagagtcctcctgatcctaaaataagcctttttgagtgtttgtttctgacgagggcttgagatttttgctggaaggtaaggtaacctttgttgggggaaaagaaaagaaaaagaaaaattaagcattaacaaataagatacccagaaaagagtgtttactcaatcaaccatttagaaaatgcacggagtctctgctgtgataggcagcaagccgagggggctgttaggagaacagcaagacaaacagaggacacatctggtgtatcagggagcaggacacacagtctgggtcaatgggtgcacagatgggacatatgcaatgagagacagcatggaaagacaggctgcctgacaggcctaccaggttctgaatgctgggccttagggggtcggcaggagaaagtcagggtttcacagccaggacatgacatgatgagacaaactgtagaaagaggagggaccagctgtacaggacagcagtgaaaggtcaagcagtcaaaagggcttaaaaactgctggggacacacacactggccaaatgcaggtcaatctgagcaccaaaaactatgatggtctggccaacatggtcaaacccagtctctacaaaaaaatacaaaaattagctaggcatggtggtgtgcacatatagtcccagctacttggtaggctgaggctggagaatcgcttgagcccagggggttgaggctgcagtgagctgtgattgcaccactatactccagcctgggcaatagagcaagaccctgtctcagaaaaaaaaggaagaagaggaatgatggtaatggattatcatctacactgaagaatgaattcatgatcccaaagcaacactaaaaattagggaagcagaggacgaggaaactctttattcagaagataccaactaataagaaatatagaattaaaaaagcagtggtttatgaccactaacaggttaactgattcaggaaaagatcatcagtggattttcaaaacactgagtaaaaggctgggagagaacaggtattcacactgttcagctatcactttagagatcaacttagcaatggcaaaagagaacagggtacctttccaatgaagcagtgtggtgggcaccctaacaaccaagtgacaaacgtgtctgaatgaggcagacagtggacctgatgtatcttgggaggtgatccaactggaagtgcacaaccctgcctgcttgtattcttgccaaaactgctcaccctgaatcaattcatagaaaaataatcaagcaaattcatgcgacacattctacaagacaagtggctggacgttaaaaaaaaaaaaaaaaaagatgtgggaggtgttgcactagattaaggagaccaaagagacaggacaaccaaatgcaatgcagacatactgcctgaatcctgggtttcttaaaacaaaacaaaaaaaatcaaaatacacaaaaatactataaagcaggggtccccaaccctgggctgcagaccagtccatgacctgttaggagccaggccgcacagcaggaggtgaggtgagcagcaagcattactgcctgagctcctcctcctgtcagatcagtggcagcatcagattctcataggagggcaaacgctattgtgaactgtacatgcgagggatctaggttgcaagttgcactctcctaatgtccccaatgccaaaaaggttggggaccgctgctataaatggcattttggggacaagagaggaaattacaatataaactatatgtgagataattttaaatctgtattctatttgttggggtgattttacaaagacattctgggacaactggagcaattctaatacagactagatattagattctactatagaattactgttagtctcacagctgttgataatggcattgtgcttatatggaagtcttttcaagagaggcttaatgaaatatttaggggtagaatgtcacaatgactacatggaaacagttccatgcagcaaacagttcaaacaacttacatgcaaatagttcaggaaaaaaatagatatgtaacaaggtttacatccataaagtgtttgccaaaaccctaagaactgatcaatctgggtggcagttatttgggtgttcactgcaatgttctttccactttctgtttgaagttcttcaatatgaacgtgaaagggaacagtacttccctctgggttccggatgaattattaaaatgctgcagatcaatgctcctgcgttaagtcctccctcctgctcgcctttttttctgctcttgctttattttcatctgtctgactcaccgtggcttctggcgatgctacggctttttctttgaacagatctccttcttcatcaccaaagatatcagcagtggattggactttgcctttaaataccaaggcataaaattacaataaggccggaaatcctaccacaaaaaatcctaccacaaaattcatagaataaaaaattcttccctcccgaagattaatatgaaagttacattgtttcttggttacttataaagaaatagtaagtggaactatactcttcccttcaaatttttcaaagagtgtattgacagctcagttgaaagacagaacaaatagtttaaccatgcagctgacatgcttatccaagcagcagtctcctgctgcggttagagaagcttggactaacttaaaaggtgaagagggatctagaggaagaaagatcacttaagaggaacaccaagtcaatcatctaaggaatctgagaaatgaaggctgggctcctgctttaaaaaaatcaaactgggctgggcacagtggctcacacctgtaatcccagcactttgggaggccaaggcgggtggatcacgtgaggtcaggagtttgagaccacactggccaacgtggtgaaaccccatctctactaaaaatgcaaaaattagctgggtgtggggcaggcgcctgtaatcccagctactcgggaggctgaggtaggagaattggttgaacccaggagacggaggttgcagtgagccgagatccgccactgcactccaccctgggtgacagagcaagactccatctcaaaaaaaaaaaaaaaaaaaaaaaaatcaaactgtacaaaagcagataaaagcaaataatgaaattccctcataattccacctgcctactcgaacaacatggacattggaaacagttcagcatacatgcttccaattcccccaaaggatgtactaatgagttaacactagttatttacaaataaggctataaataagaaggtaatttgaacaatgtgtcttaccatttgtattttccacttaatgtacctataaaaccttcccaagtcaacaagcgtagaccccactcgttttaacagtcgcacaatattccactgaatagaagggccatcgcttactctactgatgaatattttcaccacagtaaacactgctgtaccgaatggggcatgcgttgctgaaatgaggtcactgactcatgaatgtctgaagagactaggagttgtcaaagaaagcagcatcaatttactagtgattctaaatcagttctcaaagatatccactaagtgagagccctgtggagctacaaaaagcactactaccttcattcactgtcatcttcaccgagacctgcatgcattctgcatccgtttgcactctttctagattaactaggctatcgttttccctcgtgctttggcttccatccttactttctacacctaacactggaaaaggacagtaagtccagacagtctgcttctaaatgcattctgattccatctattcctatatcatccttttttattttttaaagttgctgaaaatcatgtgcaacttagggatctagggatctacctttcttttctggaagagcagtcaatggatctaagtcttgctattccaagtgtgatctacagaccatgaagcttgctggaaatgtaaattctcaggccccaccctggacctactgaatcggaatcttcattttgacaaaagcctctgggagattcatctgcgcatttaaaaacaaatgatttacaggaatgacttcaggaacacaggacttacatttaagaggaaaaagaaaggagaatgccaaaaagaaaggagtggccaagtggatgaaaaccccatcatgtgaagaaagaccaaggccacctgagctttttggcagagagaagagaagctgggaactaaacggccagcacacaaaatgctgctcatgtaattgactaaggtcagctggaagaaagtatgattaaaactttataattccaaaggtcagaactgcgaattaagcaaaaattatagggataaagacttcagctctctataaggaaaataatcatagtaattagcttacagagcagaaaagattgggtcataaaacagacctcccaggcaccacacctacgtaagtacagacacaacagctcaatgacaggaatgctggggaagggattctggtactataagagatacagaactaggtgagcttatcttccatttaggcaacattctttttctggctgaagtcctagacacagaggcaggaacaaatacctgttttggaaggtttgctgtggggtgtcgagaaaaagtcgttatcatcatcaccatcatcatcatcaaacaggccagtgggagggggaccataggggcttttccttggagtgggctgctcaggcttctgtggctccttcagtgatggaacggaggcagcacatccgtgtctcctgtgagtgaagggacaagacagacacagctgtgagccagtgtgggcctgttgaatttacagaaaaaaattatcacccaccaaaaactttccatttcagttaatccacaaaatgcattaacagggcccaatagcctccatccattactgctacagaacatctcacaatggagaatcaccaggtcactcaaacacaaaaaagtccaaggccactgagctctaggagaataagagctaatatcagtaaatgagctctttctatacgctgctcaaagccctttgaagctcccaggtacttcctcatctccagccaggctttagaagatgataattttgaaatggaaaaaacagtatttgtgtagtttttagaaaacaaacctgttatgttacctaaaaatacagaaacagctcctgctaggattttctttccaggtttggatgatgaagactctagaatgagaaagcaagggataaccatttttacaagggaaataactttccttgctattttcttcctgaaatatgtgcaatgtaacacacagctagtaccagaccttttgaaactactttttcctgaacaagccattttaaaattctttagtattttcttctctactgacatcaggacttttttggggggattgatacaatctcagctgtgactccaatggaagagcatgctgaccgtcatcaagccacagcagtgggtcagctgggggacaccaagggaggaggtgagcacagctggcagaggcagggacagcatgaccggggctcccccaaacagttccacctctacccattccagttggatgagaatgaacgagtgaaaaagaacagcaaaaacatgtgagtcatcagtaaaaaaataaagacataagagcaaagggggaaaccaagcaagtcactgatgccaaaacgtggacagcagaatgcagaggagcccgcacagcacgcacaaggagcggcttccaaggcccagctctgatgcctgtgcccgggagactcggcacttagaatcactaattcccaagtcccaagaactaccacaaacctatggagtaacatttgtaggttaaaaaacatatttatatttgtgttttttaaaaactgcaccaatgggacaggtgcagtggctcatgcctgtattcctagcattttgccaggtctaggcgggtgatcacttgaggataggagtttaagaccagcctgtccaaccgtcgtccaacacggtgaaaccctgtctctactaaaaatacaaaaacaaaaacaaaaacaaaacctgtgcagatgattttaatgcacactgggttggggaattactggtctccaacttatatacagaatgttaaaaacgtttctttaaattaaacttcattcaatgaaaatcatcctcaacattgctctagggtacttttcttgtctgactttttatgagttctctcctaacaaagaggcaagactgtggtatgggtttaccggtggtactgttttttccaagacatgaattagtgaagatgaattactttcaactggaccgcagtaaaaacaacagcttcctgcttaacacagaaacaaggcttgggaacaacctcagggttccatctcctagtgagaaagacagttttggaactctgcacacggagacgcagctgcccagccccagcttaccctccttaacagaggctccagcttgccgatcctggggggcttccgtgaagaggtcactctggttgaaataaggtatatgacaaagaattcaaaaaaccaggagaaagcatagctgcatgtgaggattcctaaggaaaaataacctacaagatttaaagctacatatttactactctgccagaaaatcagttgcaaagtgataactatggcaaaatcagaccctaaaataatttaggcctgtccaggaattaaaaacaaacgtggaagacaacagataaggcaagaaacaatcacctagtaaattattcacattaacacgtgcacatcttctcctcacctaacaaagcacagaaggatacggcatttctcactctgtgattcttagttcaaaatgtcccaaaatatgaaaatagaagcaacttccaactgagaaactgttttttccccactaaacaagcaaagcctatttcttccctgtggacccctgacacagctagctgcagggagtgttgctgagtgccatggactcacctcctcgtcctcatcatcaaagagccccttgcccccactgaacaggccacctccagagccaaatggcgagaagtcctcgtcggtcagcttggggggtgcgaataagttatcctcttcatctagcaaacagaaagcaatgttttgcaaggagtattaaagacgggtccggaactcaaattcctgggttggcgtctgcaatgtctccaaactggcatgaagtttatctgaccctctttatcgaagtgtgaggcagtctgacgaatttcacactaaccccctggcacagtccactgacaccctcaaaagactctctgggcctccactctcaagtctgtccatgtctgcggcagacagcattcattctctaggccagcaccctggatctagatttactctgaagcaagcattcaggtcagatgccacattcaagacccattccccaaccaatctgggggaaggaagggcagaataaacaaagggacctgcagactgacacagggacaagtggaatgtaatggacatggctgtttaataggaaaaggcctggtgtatcctttattgaaaacaaatgctagagatccctaagtttctatatttctaaagaattctagaaagacaagaaatgattgctgtaaaatctaataaatcaaatctctacaggaatttttactccacacccacatatcctcccagcaccccaaaacatgccttccaaggcttttgtttgtttgtttttgagatggagtcttgcactgtcacccatgctggaatgcagtggcgcgatcaaggctcactgcaacctctgcctcccgggttcaagtgattctcctgcctcagcctcccaagtagctggtactacaggcacccgccaccatgccaagctaatttattgtattttagtagaaatggggtttcactatgttggccaggctggtcttaaactcctgatcttatgatccgcccacctcggcctcccaaagcgctgggattacaggcgggagccaccacgcccagcccagaggctttagaaaagtaaatggagacagacccatttgtcagaaggaaaacagcatgtaaagcagtacttcatgaattatgtaagcaacattcccgagtcaaagcctcctaaaataacagaattgagggaaaaggcccaccgtccgaaggagttctcctttccttcttctcttgagtgtcttccgaagttttgcttctcctgagggtaaggcttgaagaacagttcacagttttaatagtactaagtcctccctcagtatacgcatcctggttctttccacgtctgtcatcctcataactcacagctaagagcaagacatctgcctttcatctcagctgcactgaaccccctgccctgcccacagtgggcactcaagagtctctttgtaaggcagaaggcttctgctttcatcccaggctcatgtgcataacaggattgtatttgttgaaagaattattatgttatctttctactctcttataactagaatatgctatatagcacattcttacgtgttcaaaatataggagtaaatattcagccaggaattcttaagctgttgcccatggttctctggagtttccattagtcccctgaaattatatgtaaagggttatctacatgtgtacatgtacgtttttcttgtgggtccacagtgttcagttatctaaaggagctcattaaccaaaaaaggaataagcactacaatttaaattatatgtagcaattactaataaatatatgtggtaattactaataaaaagagaaatccgcctttggtgaagccagcagagggccctgcactacccctcccctactccccatcaacgcggctggggctcacttgtcggctcctcgtccactcggcccacggcatcccccttgatgcgggcagccagctcatctgcaaacgatgtaggtctgcttcttttctacagcaggagaaatcaaaagaatcgcttttttgtaacaaactagtacacttcactttggacacctaacaacattatgtatacaagagcaaagaaattgaactgaggagaaaactgagtttaattaaatgaacttaaacatatgtaccctatacagctcacccaaggaatgggactcaaaatgttccttcaaagggagatgctctttatttccttatttttttaatacttgactttaatacttaaaaatctaaataagaaaataagaaaaaggtcatgggcagggagacaggagcactatggtcttcaaactctggaaccagacatattctgaatgatctgactcataaaatcataacatctggacaagaaagtggtacttgtgaggcaatttgagatgcttgccattattttccaaagtgtagatgaaatgacaaatatgcaaaaatgagagatgtacaaagtaagtcacaataaaaaataaaaaaagtcattggttctaaaaccctgccaagtgatagcaactacagccttccttacaggtctagtattttcttcaatgtcctcaatatctttctcctccttctcagagtcagcaaaaaggtcacagccatcatcatcctcttcctcatcactcacttgtgtgatgtgctaagagtataaaataccaaattagaactactagttattaagctaaagaagagatactgccacttagcctttaggctcctccttcaaaatcgtaacagctgtttaaaataataatcataatcacgatgcagtaagttataaagcaaaagatgtgctggaacaaataatacacaagatttacttcaaatctaaataaaaatgcaatctttaataagaatgtaaccacaagaatataaaaagcaaaatattaaaatatcaaaattgtctgttactagagaaatatttttatttatttactttttttatttttgagtaattttgttgttgcccaggctgcagtgcaatggggtgatctcgcctcactgtaacctccgccttctgggttctagcgattctcctgcctcagcctcccgagtagctgggattacaggcacctgccatcatgcctggctaatttttatatttggtagagattggatttcaccatgttggccaggctggtctcaaactttttacctcaggtgatcaaactgccttggcttcccaaagtgctgggattataggcatgagccaccacacctggcctattactagagaaatataaacaaaatcagtatagtcttaccttagtaagaatactgagtaatagttaaaaggtaaaagctgtaacaattagagagccatccaaggtaggtcaagcaaaaaagtgccaataacaaatccagcacgataccgcgccccctctacatacaagcatttctatggaaacagatatatttataaaagcaaagaaaaagacgtggaaagacatgctcccagagcatgatcccagttacctctgaagagtatgcagagaaagaaagtactggaaggctcaaacttagcctcatctgttaagttctaatttttccaaaggtacacagtagtatgtataacaaaaaaaaaattttgttcaatgtttgaatcaatgaactgtgccaggcatgttactaaaagcactttattatctaatttaatccttacaactttgaggttagctgcagcacacaaaaccaacctgttgcataagctagtgcttttactcactatactgtactgttttgaaaaacagtttgtggccaggcattgtgaatcacgcctgcaatcggagaactttgagagggtgaggcaggtggatcacctgaagtccggagtttaagaccagcctggccaatatggcaaaaccttgtctccactaaaaatacaaaaattagctgggcatggtggcacacgcctgtaatcctagctacttgggaagctgaggcacgagagtcacttgaacccaggaggtggaggttgcagtgagccaagatcgtgccactgcactccagcctgggcgtcagagtaagactctgtctccaaacagacaaataaataaataaatgggctactctattcaggagaaattcagattttggagtcacaatgtttcagtgataaattccagggtgtgggacgtagattaagggtgttaagttcgtggccactgaagttacccatgatggtgttacataaaatccaagtttggtaattggctcgcctcaattttaccaaccaagttccaagttctaaagtgtgtatgtgtgtgcgtgcgtgcgcgcgcgcgtgtgtgtgtgttttaatgaatgtgggggaagtggaagaggttggtagatggtgacttaaaaatgaagtccccttaagactctaagactgtttttgcagacagcagtcttagtcttcttccaggctggagtggagtggtgcaatctcggctgactgcaaccttggtctcaggggctcaagcgatcattccacctcattctcctgagtagctcgaactacagatctatgccgccatgtccagctaattttttttttttgtagatatggggtttcaccatgtttcccaggctggtctcgaaccgccttggcctcccacagtgctgggattacaggtgtgagccaccacgccagcccagccttagtgttaacactgttataggttactgtaacatattggctcacagtgtgtgttctcgggtctgcctctttcctggttacctaatcataagtaagttacttctcctttctgtacctcagtttcctcaactataatttggaaataatatttcctccctcatagtcattgtgtgaattaaatgaacaatgtataaagtggtaaatactgaacacttgataaatgttagctattattaaaggagagactgatatttaaatgattacaatacaatgtaataccttaggataaatacatcaaaaacaacttttttccttatttattttacagctttattactgatttccctctaaaaagagacccaaataaatgtggagcgactcattatagagtaaggaatcacaaagtaccatagtcacgtaacaaaagcaaaaaaaaaaaaaaagcaattgttttacctttcaactgctgatgttatgtacaatctatcacaagaagcatagctgtgcattcatgagctgattgtattaacctctagaattttagaaacgagcacatctaagcatgtggatactctcttaccttacaaagtaaaagcaagcattttctattttaaaatttttatatctgtgtaaaacgaagaattcctggaggtcaaataagaaaaatataccaaactcaaaacactattaagtcatgaaacgaagactctgaggtagaagtcaagcaatataatccacaatttcaggtattcccagcaaccatcgcatctcgcaagtaagatgtatttttttttaaagtctcaacttccaaaaaatcaataatccattctgtaaaatcagatgtaaaactatgaccgagccgggcgcagtggctcacgcctgtaatcccagcactttgggaggctgaggcgggcggatcacgaggtcaggagatcgagaccatcctggctaacacagtgaaaccctgtctctattaaaaatacaaaaaattagccaggcgtggtggcgggctcttgtagtcacagctactcgggaggctgaggcaggagaatggcatgaacctgggaggcggaccttgcagtgagccgagactgcactccagcctgggcgacagagagagactccgtctcaaaaacaaacaaacaaacaaacaaacgacaacaaaaaaaaccaactatgaccgacagaagacacccaaacttttgtcgtggtaacacagtaaatgcttttactaaaagctgccaacatttctatcgtaagggggcagctggttgtaaccttaatgtccatattggtcgggatagtaaggttcttgtctgtgttgcgggtaattgttaccgcaggattgtccacgccactgattggatcgattgtcacttggccacccccatctgccgtccctgcctctgaactgtctgctatcttgcaaccgattgtctctgtttctttggttcccaccagctctgctattccattcctcaacaattggagaggactcaggagggcgtttcaagtattcctgatactcctcgtcatcttctgtgaatctactagcaaacatctcttcaaaatttggaacagctttggcagtgtcagtcattctgaaattcccaaagatttgaggcagctgtattgtttaatgtttaggttgtttaaatccgccaagggctgtgtctatctagctcgggccgaaccccgccagcgagacactaagagaccgcaggagaggtggcctctggcccaccacaccgtggaactccagaccaccccagctctccaatgtagcggagacccttccgctagccatagaaaataacttaagtcacttaagctgtacttggggtaatcaggttatttaatgaggtgataactgaggtgactacaaaagaaaagtctgggattgggtgtgtgagcaaggtgcatggggacagtggtatgttctaggttgaaggctcaccctaggccaagcaccgtggcacctgttttacaatatcataactttaatatcacatccttgcaagatatgtagcttcgttttactgaggaaagctcagaaaagttaaataactcgcccttgggcacacatgactggaaagaaattgggatttttattttagtaagtaagttggtcaggcacaagggcgactcagcagagggaacttcaaggaagtgtgagacaacagctggagccctgagctgggagagtggaggacgaattataaagagttttatgcctgccataatgagaagcttgtccttgaacttgaggggaatgctgagagtgcaaaggactttaagcaggccctacacagtggcagccaagcaggtcataaagagcaagatgatgcccaggcagatcagggattctcttatctacagagcgtccgcctaccagctccttcacagcagcggattttgctgcaagagaagaggcagcaggccaggccttttccttcgcccacagcgcctacgtcgaaggctcccaggctggttgctccactggctgcttgaggtcccctctctccagacccgccgaactggcggccggtgctttggccgatcccgcgccgctgcctcgggccttgggcggcagcgccccccgcccaacccgcctctgcagcgttcctggcgtcagcccctatcctccagcttcctccgccccaacctagggtagaaccccaaactccagtcccagtccacttccgcagcttcctcccctcagcatcgcaggtcggatcacgtgcgggttctgtcacgtgacatcaggtcacgtgaggccggtcacgccccgggcagcttggctggggctaggcttccggggctctgcggtcctcggcctgtgctggcagcctcggagcccaccgagccgggcggctgggatggtgagggcggcgggccggagaggggccggcctgggctggggccgccgtccctgccgccctcaggctcagcctctcttctcgtttttttcgctgcagatgaaccggacgacccccgaccaggagctggtgccggcgtcggagcccgtgtgggagcggccgtggtcggtggaggagatccgcaggagcagccagagctggtcgctggcggccgacgcgggcgtgagaggcgggccccggggacgcgagagcggcaggggtgacgcttggcttgcgcgcaggagggccggaccgcgactgcccctgcacctggcccgtcccgttgcctgccctcttaggaacacacgccccgtttagcccccgagaatgccaccctggcagtccccggccaccagggagaggggcagaccctgaccgtggcccagacgcgacgttcccttcatggggtttctggctcagctccatccggaggggagatccgtttccgccacactgagggattgctcgggcactagggaggcgattcctgttgggacctggactaaatggggtgggaaacaagccagtatgtggatatcctttaatgggattcttcaaatcgggggcccaaaaagctcagaactgttcgagtcccaaatgaataggatttttgaataagagtggtggttgattagctaacccttggtctgtgatctctgtagattgacaaccaaagaggacttttaaaaggagacagggttttgccctgtcgcccaggctggagtgcaagtggctcgatcttggctcactgaatcctctggggttcaggtgatcctctcacctcagcgtcctgagtagctgggactataggcgtccaccacacctgtctgatttgtttatttatttaattttagtagagatgggggtcttgctatgttgcccagactggtctgcaactcctggactctagcgataaccctgcctcagcctcccaaagtgttggattacaagcgtgagccaccatacccagtgccaaaaagggattttaaatttttccagaaacgagataggtgtccattagctcactgccactcttttgatgagctttcttagtgttttccaatgtcacttggttttagtacttgtcaaaccagcattccggccgggcacagtggctcacacctgtaatcctagcactttgggaggccgaggtgggcgaatcacgaggtcaggagttcgagaccagcctggccaacatggtgaaaccccgtctctactaaaaatacacaaaattagttgggcgttgtggcgggcacctgtaattccagctactcgggaggctgaggcaggagaatcgcttgaacgcgggaggtgcagtgagccgagatggcgccactgtactccagcccaggcaacagagtgaaactctctctcaaaaaaaaaaaaaagcatttctttcacattctaacactcaaaggtgaaaggaaatgggttcttttttgatgtgacatgcagaatagttacatgtaacattgatactactgtatgtttattttttaaaatagctactacagtttctacaggaattctcacagcaaactatctctaggacccatgaaatcaagaaacaagtggacggactaatccgggaaaccaaagccacagattgtcgcctgcataatgtcttcaatgacttccttatgctctctaatacccagttcatagagaatgtgagttatttagttatattataattccttttttgggagtaggagatattgtaattttaaataacttactgttaggttccctcctaaattttggtggaagtgtggttcttggtaattgtagcttttttctctgggattaacgcctcttttttatttgtaaagttttaagtccttttttccaagcctctaaaaaagtctaatgataaaattttcttatacttcagtgcttccatcttttgtcgttttgagagtagtcagcaattgtgctgaattgtgtggcactcacactgcctttgttgtggcgtgatctgtaaggacagctgtttacctggttagaccctctggacaccagcatatggtttcagttgttgattggggtcattctgttctgataaattatattcaggggatatatatgtctgcttgcaatattctcaactaaagtttatgatggccgaacttacaatatggaatcaactgtaaacagattactgagcttaaatctatgtgtgatttctgtctatttactgtttcttctaggtggtaggaatacataggtaaattagatagagcctctcccttggcaaatagtataattccagcatacaaaggaagtaagtatggctggagcagagtggagacttaagagatgaggatggagaggaagcttaggtaacagacctgtgtttctcatagggtgtcccaactttctgaatatcagcattcatttgtggaaaaaggattattaaagtaagcgatctcccgagattgttagatataaagtaataaaattttcagaatcacaaaattattaaaaaagcccaagatttagaatagttaagagaatgccatgtagtcaacttgtgcagcatgtttgtgcattttttaatagctcaagttaaatgccacttcctgtctttttttggagagctatatataaaataaagacattaataaaggtgttagagatctctttgccagttatttcctttaacagcaaaggagtacttatgagtttgaaaaataacaagtattcggccaggcgtggtggctcatgcctgtaatcccagcactttgggaggccaagacgggtggatcacctgaggttgggagttcgagaccagcctgaccaacatggagaaaccccgtctctactaaaaaaatacaaaattagccgggcatggtggcgcatgcctgtaatcccagctacttgggaaggctgaggcaggagaatcgcttgaacctgggaggcggaggttgcggtgagccgagatcctgccattgtactccagcctgggcaataagagcgaaactccgtctcaaaaaaaaaaaaaagtattcaagtaaaatcagtagttttctgattgtttacacagaatgtccatgcttggtcctgactatctcactggaaaagtcagggactctagactcaacttctctggtgtgcacagccccataatgttttcatcaagattaatttggtgtccttttaagcactcctgttcttttcattctgtacttttcttgctggatcaggtagtcagcacttctctgcagtcagtgctgcagcaccagagtcccaaaggatttgggaagtttctttttttttttgagatggagtctcactctgtcacccaggctggagtgcagtggtgcgatctccgctcactgcaagctccgcctcccgggttcacgccattctcctgcctcaaccttccaagtagctgggactacaggcgcgtgccaccacgcctggctaattttttgtatttttagaagagacggggtttcaccgagttagccaggatgatctcgatctcctgacctcgtgatccgcccacctcgacctcccaaagtgctgggattacaggcctgagccacggcgcccggcaagggaagtttactttgtacccagtgtgcctgtaccagattggtactagattggtaccagatcaatacttcagtgggaagaaatggggaacatcatacaatttttctcaatcacagtcttaggtcttatcttttctccagctcttttctagccaagttttcgtagattctgagttttccatgttgtagtttttgtggagtttttttggttttgttttattgtgttttggtaattgttctttatttctgtccaatactggggatttcctgttttccatccatctctccatccctttagccttagcttttttttttttcttccgagacagagtcttgctctgtcatccaggctggagtgcagtgacaccatctcggctcactgcaacatccgcctcccgtgttcaagcaattctcctgcccacacctcccatgtagttgggattacaggctcccgccaccaggcctggctaattttttttctatttttagtagagatggggtttcaccatgttggtgagtctgcttttgaacttctgacctcaagcgatctgcccattgcaacctccgcctcccgggttcaagcagttatcctacttcagcctcccaaagtgctaggattacaggcgcgagccactgcgctcggcccttagtgttaagtcttgatgccccttcgccttccagtctgcagccagaactcttctccggatgtgctggttgccgctgccaaatcttaattacttcccagaccttccataaggccacatgctataggtttttttcatttgtggcaaagcatgataatactgagaaaacagctaatgcataataaaactctgaaaaaatatacttgctgatatatatttgtaagtgatctggctttttttttttttttttttgagacggagtctcactctgtcgcccaggctggagtgcagtggtgcaatctcagcccactgcaagctctacctcccgggttcatgccattctcctgcctcagcctcctgagtagctgggatgacaggcacccgccaccacacctggctaattttttttgcatttttagtagagatggggtttcaccgtgttagccaggatggtctcgatctcctgacctcatgatccacccgccttggcctcccaaagtgctgggattacaggtgtgagccaccatacccggcaatctggctttttaatgttttattttcaatccctgacatcagtacttaggtgttacaattccagcttgaattatggtgccatttggtttcatggtaatttatcagaaacattcaaagtcagataggtttctgggttttattaattagcctcaggggcagccacaaagttgcaaactatattataaagttagtgaaacaatccgtactttctagggcgagaacagtcaggactttttagggcaagagaaattagtaccattagtaaaggctcaagaggggacttggagggagaagaaatactaattaacattggccagtgttctagtgtctaattagaaggcaacacaattctaaaggcttaattatctgttaatttaggaattggatcctgaaatagcaagtgccatagttaatgactttagtttgttaaatgaactggtgagggaggattttttctttttaaagtcaattgtttcaaaatcttagctttgtaaaattaaaaaaaaaattccagaatgaaacaaattaacctgtttatgcccaaggttagaattttttttgtgaaaagccagaccttggcaatgaccttgagcagtaggatatacataattctgacaagcttagtgttccaataatgggacactaggcataaatgggttaattttccagatcatcttcctgttgatttataaaagctgaattttggtcatttttccctccttttctacttttctattgaagaaacagatggagttgctgaaactgtcaagtactcagcaattagagagaaggaggtaaagcccaaaagccttattaacatataatttcctgcacaggtttttccctctccccctagacctgctttattttacataatgccccttgcttttgacactccagccttctcattccttggagatgccatatgccctgctgctacggggcctttgcttacattgcttcctatgcctctaccctttgattgacatctgtctgtcttctaggtctctgctcaattatattacttcctcctggaccctctgcactaggcacaccccctggataaaagcagctgaagcatcacattctttagtagacttcttacaattgtaattttacaattattgatgggatttgatgagttggaccctcccactaaatcaagccccatatttttaacaacaaatatatttgaggggtccagcacaagcctgatatttagggatccagtgaatatttgaatgaatgagagtacgcataaatgaaaggggaccagggctgtgtatagtctgttactctccagccctggtccctttttccccagttcccctctttccccttttaccctgtctccccagatgaggagcaataccaaagatatttaacagtcctgggtatagctatctgactgtaaattgatcacaaaacacatgaagctgtgagtttagcaggtgaggatgaaagaagttagcattggttatctgctggatatgaagtacttgaggatgcatagtcctgctcaccctgaaaagatcccatgggctttaggtcccatgggtttaggtttcttagatgtcatgtttggctttctagctgcaggctgctgatgggtaaccatggtagctgccaggtcttaaagtctcacttttgagatttacttaactttttggagtcctgactttgaaaattaccaaagtaatccctgatctttatagagcaattaggaaaagtaagaaaaagaaaaatcatgtgaaatttcctcagcttgaggggagcctctcaacgtttagcacatatattctaagtccatttcccatgcagacatcaggcttaaaagaattgaacctacagtaggccgggtgcggtggctcacgcctgtagcactttgggaggccgaggtgggcggatcaggaggtcaggagattgagaccatcctgactaacacggtgaagctccatctttactaaaaaatacaaaaaaattagccaggcgtggtggcaggcgcctgtagtcccagctactcgggagcctgaggcaggagaagggcatgaacccgggaggcagagcttgcagtgagccgagatcccgccactgcacttcagccagggtgacagagcaagactccgtctcaaaaaaataataataaataaataaataaataattgaacctacaaaaaatcagctaccccaaattaaccaaccattgaacttttcagtgtatttttttctgttcttgttttttaactttaaccttttctagatgactgtgtgtgtgtgtgtgtgtgtgtgtgtattttcatttgcagcctactttttttcttaatgtgaacttatttaacccatctttgagacttttgtgaatttaatttttttgttcttaaaccgtatcataatttatttaataatcttctaatattaaatgttatttatgaaatgtttcataaatttcataaatgtttcataaataaatagaaaagttcagagagaaaccacaagtgctaagaaaatgtagcacctagcatcagtggttttgtatcttgccacatttgcttcaaaggtgcctacccaccatattcgtccttaactctaatcattttgggtggggattccttggtatctctgcctttttattctttttttgtttttgagacaggatctccctctgttgcccaggctggagttcagtggtgcagacagctcactgcagcctcaaactcctgggctcaagccatcctcccatctcagcctcctgaatagctggctaggaccacaggtgttcgccaccatgcctggccaactttttattctttttacctagagagggatttcatttttatcccttatagataacctttattgtgtagttgttcttttcttcattgactattatgtatgaatgtttgtgtgtgtttatgtgaaaataaaatcaggcctccatggaattgtgggtctgtttctgccctctgctgtttgttttgtttctctgctgtttgacagtatcataatcttaaatactgcagatttctaatgtcttattagggcaagtccccataatctgtttttattcagaattgtcatggttatcaatctttggctttttacttttctgtgtgaatttgaggattatcttttacttatttatttatttttttgaaatagagtttcagtcttgttgctcagactggagtgcaattgtgcaatctcggctcactgcaacctctgcctcccaagtttaagcgattctcctgcctcagcctcctgagtagctgggattacaggcaccggccaccacatcaagctaatttttatatttttagtaaagatggggttttgccatggtttcaccatgttggccaggctggtctcaaactcctgaccgcaggtgatcccaaagtgctgggattacaggtatgagcctcccaaagtgctgggattacaggcatgagccactgtccccagcaggattatcttactatattgtgccacagaatattttattagcgtttgattggaattacatagaattataaatttggtatttgtgactttctgctggaaatcatgataccatgaacattctgatgtttgcgtttatgataattttcatgggagctaaatttcaagaagtagaattttgggtcagaggatatgatcatttaaaagcaacattgtttgatcagattggcagatacttaaagatgggtggacaggagccattgctggcaaaggtttgggtaaggggcacttgagtatgctgctagtgacagggaattctacgcatttgtgcatagaatctgggaatgactattaagatttatttattccctctctaggtaaaatccttctctaggtatataaataaataataaataataaataaataatcagtttcagccaggcacaatggctcacacctgtaatcccagcactttgggaggccaaggccgatggatcacttgaggtcaaggagtttgagaccagtctggccaacgtggtgaaaccccatctctactaaaaaaaaaaaaaatgcaggccgggcatggtggctcacacctgtaatcccagcactttgggaggccgaggtgggcgaatcatgaggtcagattgagaccatcctggttaacatggtgaaaccccatctctactaaaaatacaaaaaaaattagctgggcatggtggcaggcacctgtagtcccagctactcaggaggctgaggcaggagaatggcgtgaacccaggaggcagagcttgcagtgagccgagatcgcaccactgcactccagccttggcaacagagtgagactccatctcaaaaaaaaaaaaaaaaaaaaaaaaaaaaaaaagggcaaaaacaaattagccgggtgtggtggtgcacgcctgtaatcccaattacttgggaggctgaggcaagagaatcatttgagcctgggaggtggcggttgcagtgagccaagatcctgccactgcactccagcctgggtgacagagctagactctgtctctaaataaataaataaataagcaggaagggtaggagagctctaaatatatgcacgtgttagcttatatttgtgttcagagcctcaggaaatgagcatacacaccaggcttaaattgggtattccaaggatcaggttggggatagggagggaactattttaaaatacatctcttttccatgtgcctttatattgacttaaaattttaaaaattgagatagaattcacataccataaaattcagtcctttaaaaagtatacaatttggtggtttttactgtactcaaagttttataatcacggccactgtctaatgccagaagattttcatcagttcatttatattgacttcttatttctttctttgtaaaaaattttaatttcatttcattttatttttgagatagagtctcactttttcacccaagctgcagtgcagtggtgcaatcagggctcactgcagcctttacctcccaagctcaagagttcctcctgactaagccccacaagtagctggaattacaggtgcacaccaccatacctggctaatttttgtattttttgtagagatgaggtctcactatgttgcccaggctgatcttgaactcctgagctcaagtgatccccttgcctcggtctcagagagtgctggccttacaggcgtgagccaccgcacctggcctatattgactttttataacaagcatgttgtacttcggtagtttttaaaacataaaaatgattttaaaaaccaagaatcacagtgatttggcagagcagtgggtcttttctggaaaagagagtcttgcctacccatgctgtcagggttagtcaaatgcccaggctttctggcaagtcagtggtagatttttctctctgctttcatacaaatgggataataaaaatttatcagccattttaagcaactgaatgaaaataagttttgcctttaccattttccttgttcaaaatcctgaagttctagtttcctagttgataaattacatcagttgacattctccataagctggggtcagaatactgtatcattgcccatcaacattattaggttaaatgaaaaggtgtgaaaactgatatcttactgtttttgcaactcttggtttacaacgaggttaaagtttcatcatgtttcctagtcatttgtatttaaattttttttttttttttttttggtgaatggactattctttgctgttagtccatgacccactgttacggacacccacctggtagtggtctcagccctttgctgaataaccatttccttccgcatctttgtccttagttactgtgtgaattcttatattgtgatttatttccaatgacgtgttgaccttttaacattgagtttgcttccatatttagcgtgtatatgatgaagaagtggaggagccagtactcaaggctgaggcagaaaaaacagagcaggtacttgtataaaatcactcttagctgagtttctgactttgaaaagtgtggtggagatcgatgtgttatgtgggaactgggggatggtgggtggggttgggaaagggagggactgctcctgacagcagcccaagaggggattctttcctttgtttctgaaatgtagtatattaactaatacagagatcaaatccttgaattctgatataagaatagagtagaagtcagcaaacttcttttgtaaagggccagatagtacatattacagatttggagggtcacagaggtcatttttttcctgtggcttcctgagttacagatggaccagccttcttcctgagatcttctcacaccagagcccaaaacatagctaagaggttctgggtcacactgacttcttagcactccagcagagatttctttttcttccactcaggaaggcacatggactgtgaataagtttattattggagtagctttgattttgttctcatttattcagaaaatatggatcacctgtaaaggttggccctttgtcagcaattattacttgtaacagatgaagctgttagactaggaaaagggtattcaaaaccagctatagttctgcctgttgccagcatttttttaaaaaagttattttattttattttttatttaaaaaatttttttattttgagatggagtctcactctgttgcccaggctggagtgcagtggcacgatatcagctcactgcaacctctgcctcctgggtgcaagtgattctcctggctcagcttcccgagtagctgggactacaggcgtgtgccaccacgcctggctaatttttttgtatttattgtagagacggggtttcgccatgttggccaggctggtctcaaactcctgacctcaaatgatccgccagccttggcctcccaaagtgctaggattacaggtgtgagctactgtgcccagcaggttattttatttttaatagaactcaaggatttgctagccatttaagtgcagtagtatctggttataccaattcagggtttaatttgaaggtgataggtatttagtgtactatttttaaaaactgctatatatttcatacacattttcacaaactcagtacaatattagctatttaactcagaatcaagcatatccaaatagaaaaatacacaaccaagacaaaaaagttcagttagaaagacttcagtacttgagataaaagactaaaatgctcgtagggtttttttttttttttgcctttggccctcagaacaacactgtgtggtttggttccttctagaatatttgtagagggggaaatgacactaaatatttttcggtatttctcacaatggcacacttgtgtctgtggggactgccattgagaactgctgttgcaggaagaagacacctgagggagattctcagcctgttggtgatatgaacaaaccttttttcttgaatggggcattgttgtagggtatacacagaatagaccggagatgaaaatgacccccttttgatgtagaacagatttataaaataattgtaattgtccagttttttttttttttgtctctttaaactgtaattgaaaaatgagacctctgtgaccttccttctaagtcttaacacctaaaattacccaagggataaccagggctcgtgggatagtcatggtgagtctgagagtctaggccctccagcagtggggaaacagcatgcattcattgttgggatacttctccacacactagttgtacctctgcttttgtagacgatgacccttgagctctggaaccttaggtagtttgatgcatgtccagaaaggggcaaacttgggatttaaaacttgcagtcttactccaaagtctgtgtcaaggcattcagcagaatttgacttttttaacatttttaataagtttttttggagcttgaggctaggctttagagaacattcacagtattcttttggggcagtatcagtatattggagacccatactgcatggtatttattttgtaggagaagacacgagagcagaaagaagtagatctcattcctaaagtccaggaggctgtgaactatggcttacaagtattggacagtgcctttgagcaacttgatatcaaagcaggaaactcagactccgaggaagatgatgctaatgggcgggtggaactgatccttgaaccaaaggtgaagacattcaacttaaatatttattgcacaactattatgtttgggctactttaattgggcacacgattagtaagtcatggacttaacctctgggaagtgagtatgtcacttagtagtctcacattgactccaccagaaagactcgctttacctgagcactgatggagtacttgtgaggtgcaaggcaacatgtcaagttggggtgcaaagatgcagagcatggcctctactctcgaggtgtgtgttgcagtctggtgggagagaggagacatacatacgaataaccattgtaaatgccctgagagagaattgatttccagctggaattttggggcaaagatgatatttgaattggggtttgaagggtggggaggctcaaaagagacagagagtgttgggaacctgaaattatgtagcttgggctaaggaagactgcagaagaactgaaaggcatttgggttgtttccggtttgggcaattattaaatacaaatgaagctgctgtgagcattcatgtccaggctccctcatagcctagtgagtgttggttgcttgacacactttctcccacattgttcaaagagacaattggggtgacacagagtctctcggtagtgaacacagaaagttaccacagtgatttatagaaagaggccttgtgacacacaaggccttccgaattaaaacatgccacagaaccaaacccttttttttttttgagacggagtttcactctgtcctccaggctggagtgcgtggcacgatgttggctcactgcaacctctgcctcccaggttcaagcgattctcctgccccagcctcccgagtagctgggattacaggcgcccaccaccacacccagctaatttttgtatttttagtatagacagggtttcaccatgttggccaggctggtctcgaactcccaacctcaggtgatccgcctgccttggcctcccaaagtgctgggattacagacatgagccaccccacccagcctgaaccactcttctagtcattctgtagctgcacatttctcttccagtttgagctttgctgagtcacaccaaattgaggcagatcatttggcactgaccagtacacttgctgcttggattttcactgtatgcctttaaaagtcagcagtggactctgggaaatggattgcctggaccacacttgatacttccaagacacacagcactttctcccttttttttttccccttgcagagaaagttgtggaggtacacttttcttttgtaggaggatttggggatgtcttctgagtcagtgagaattagtccaaattaacgctgtctttgccttatgctccattggttgctgtgacgtcgttgaacctttactttaaccttcccaatctttctgttgttgtgtgaaacgtcagaattattctcccctgccccagagtcctttgacaaggaagagatatcattgccaaagggcaatgcctcacaggggacagggcagcatttccttcagcagtggaggtaggaggctgtgcaagggtggagcactttcttgaccctatttttttttttttttttgagacagagtttcactcttgttgcccaagctggagtggcgcaatctcggctcactgcagcttctgtctcctgggttcaagcgattctcctgcctcagccttccaagtagctgggattacaggcatgtaacatgacacctggctaatttttgtattttttagtagagacggggtttcaccatggtgaccaggctggtcttgaactcctgacctcaagtgatccgcccgcctcggcctcccaaaagtactgggattacaggtgggagctactgcaaccgaccaaccctaaatttttaatgtgtgtgtggtgtgggactgacaggagtagacggctgacatgggcagatctccagcatgtgctgttggggccacagtctcctgccctcactctgttttctcatctggtcttattttaccaacttcacttttctaaattcaacagtgtggaaccactagggggtattgttcttctgtttattgagttataatcttttttatttatttatttatttattttgagtcggagtttcgctcttgttgcccaggctggagtggagtgatgtgatgttggctcactgcaacctccacctcctgggttcaagagattctcctgtcttagtctcctgagtaaatgggattataggtgtgcgccaccacacccagctaatttttagtattttcggtagatattgggtttcaccacgttggccaggctggtctcaaactcctgacctcaagtgatccatctgcctcagcctcccaaagtgctgggattacaggcatgagccactgtgcccggcctaatctatttttatattaaaatatatagatatattatgtctcattagtactgctttttaggggacagctcaccagaatgttcagtttctttccttggtcctcctcttcttggaccttatactaggaggttgtacccttttccctgtttgcttgctgctgatagacttttggtaggcttttgccatttttgttaaattttgttaattaggcccttggggagggagattctgtgtgatacagctttactttggcatcttttttctttttttttttttttgagatggagttttgctcttattgcccaggctagagtgcagtagtgcaatctcagctcactgcaacactgtttcctgggttcaagtgattctcctgcctcagcctcccgagtagctaggatgacagttacccgccaccatgtcccgctaatttttttggatttttagtagagacggggtttcaccacgttggtcaggctggtctcaaactcctgacctcaagtgatccacccgccttggcttcccaaagtgctaggattacaggcgtgagccatggtgcccggccttaccttgacatctttacctaggatttgacttttaaaaaaatcagtgaaaaaaagaattttttttttaacttttagtcctgctgtgtttcttattctccaccttcgttatgtagcttgtttgggatagtcagatggaacagggtatcaggtggcacatgtaagtttgttttcaactgaaatgtttgacagcctattcctttcatcatgtacaggatctatacattgatcgtcctttaccatatctcattgggtcaaagctgttcatggaacaagaagatgtaggtcttggagagctgtccagtgaaggtacttttcttcaccaaataattttattccttaacatttcttttttattttaaaataatttcaaattttacattaaagtttcaagaatagttcaaagaactctcatatacccttcacctgggtttaccagttaacatttcaccacatttgttagattgttctctacatatacgtaatattttgtcttgagcctatttgggagacatcatgctcatgccctgttacttctaaatgtttctctgtgtgttttctttttttcttttctttgtctttttctttttttgagacagagtctcgctctgtggcccaggctggagtgcagtggtgcgatctcagctcactgcaacctccgcctcccggatttaagcgatttttctgcctcagcctcctgagtagctgggaccacaggcgtgcaccaccacacctggccaatttttgtatttttagtagagatggggtttcaccatattgtccaggctggtctcgaattcctgacctcatgatctgcccgcctcggcctcccaaagtgctgggattacaagcatgagccaccgtgcccggctctttttctttctttctttctttcttttttgagccggagtttctctctggtcacccaggctggaatgcaatggtgcgatcttggctcactgcaacctccacctcctgggttcaagcaattctcctacctcagcctcctgagtagctgggattacaggtgcccaccaccacacctggctaatttttgtatttttagtagagatggggttttaccatgttgggcaggttggtctcgaacgcctgacctcaggtgatcctctgtgtgtgttttctaagaacaaggacatctcttgtataatcacagtagaattacaaagccaggatattttcctggacataagggtattatccaatctgctgctatgttcacattttgccgtttgtcccagtgacaccctttacagtctctctcttttgttctgtggtccgggactcaatccaggaccagccaccacatttggttgtcaaatcttcagttatcttttaatctgatgccatttctcagcctttctttgctttttatgaccctgacatctttaaagagtacaagcaagttttttttttatttgtaatgaataatttttggggggagagatacttcaagactacataaatatgtaattcctcaccataatgacactttcaattccagtaagtgggtatagatggttttatcaagatctctgtgatgctgttgtatggtggtttgtgattttgagctaaggacattttcttgtgaatattggtgtggtgacccttatctctcttctcaacagaaggctctgtaggcagtgatcgtggcagtattgtggacactgaggaagagaaagaagaggaggtaagggctgtttggtatgaccaggtcacggtgggcagcaagcttaatttaagatgggcctagcaggctaagtaaatagcataactgtgaattcgtaatctgcttccataaagcttttaacagtgatagaagccacattctgagttttttttcccaagggttagatttcctttttgccttatgtacaataatagggaaagctgctttcatctcttccactattatcctctctcccaccttgccaccaaatatctctttcacccaatatatttttgagaagggcagcttagatgttttggtggaatctctgcctgggatatagtctttgagtatattccgtctttgaataattctaagggaaaaaatctacatttagaacttttgtaaactataaaacctagagcaggatataccgaaagccaccacttacattctattttgctgctgccgctagcgctttcatatccacagagcataatttcatttccttgtctagagtttgagtctgtgggccttgactacagttgaatctgtagttgttctttagatgggatattcgttattggaaaggacacagccatgttgcaggagagtcctcgagtatgggatttccgaaaggagacagtgttgtgtatgtgcttttctcttctggttggtccccctttctgcactctccctgcccgcctttcttccagtcctccaaagaaaaacctgacagcaggaaatgagcttttcttaagtaactttcgtataacaaaagcagtgctcattaggggaatcccttgcttttagccaccgatgtggcacttctatgtggcacttcatcaatagttgctcgtagcaactattgatgtccccttcttgggcctaatgaagtagttatttttattttttatttttattatactttaagttttagggtacatgtgcacattgtgcaggttagttacatatgtatacatgtgccatgctggtgcgctgcacccattaactcgtcatctagcattaggtatatctcccaatgctatccctcccccctccccccaccccaccacagtccccagagtgtgatattccccttcctgtgtccatgtgatctcattgttcaattcccacctatgagtgagaatatgcggtgtttggttttttgttcttgcgatagtttactgagaatgatggtttccagtttcatccatgtccctacaaaggacatgaactcatcattttttatggctgcatagtattccatggtgtatatgtgccacattttcttaatccagtctattattgttggacatttgggttggttccaagtctttgctattgtgaataatgcaaggaaatagagacagtatagtccaaaatgtaaaataacacaaactgactttcagtaatttagttagttaaatgtgcaactctttaaatccaaaggcaagagttgaaagtgcaggtgatgtgaacaaattgttagaggcatttaagtgaaccacaaaaattacatgttaactggaacaacccttcacaatattgccagctacccagcttatctgcaccttgatacttaaggtgaccagtagtcagtacaaagagactgagtgtcagagctttttctccacttgacatagaatcagcctgccccagagacttagacctgcaatcatttctgtgcttctaagtaaagcccatttaacaacaaagccttttcttacccataaaggagtcagatgaagattttgcccatcacagtgacaatgaacaaaaccaggtaaggctcatatattgaaatgactttgtttttacattttaattgaagcatagtatatatactaaaattactttggaatgatttatgaccaagtgaggattttttcatgtatacaatttattttcctttaagcatttcatgtatttaggctaactacctcctttgtatatattttttccaattttgctttatagtttatttttcttagaaaagaagtttcaaagaagtgaaaagcacaattggaaaacagagcctctaaaagaagactcagttacccaaactgaactactttgcatgagtccctcttctgttttaaaattggagacaatctagcagtaacattattgagtattcacaagatgaaaacttcttaccctactgtcttagcacggttatcttaatttttgaatatctaaaggcgtattcttttcatagtgtgcatcgttcattttctgccattttatgttaacattttataaatgtgtccttatttattattattatttttttgagatggagttttgctcttgttgtccaggctggagtgccgtggcgtgatctcagctcactgcaacctccgcctcctgggttcaaataattcttctgcctcagcctcccgagtagctggcattacaggtgcccaccaccatgctcagccaattttttttgtatttttagtagagatggggtttcaccatgttggccaggctggtctcgagctcctgacctcaggtaatccacccaccttggcctcccaaaatgctgggattacaggcgtgagccaccatgcctggcctccttattttaaatagcctttgcagtttgcgttgtaaacttctatacttttaaacatactgagtatgatactgtcatagtctctaaatgtataagggaaagagtttatttctagagttgtatttttgatgtaataatgtattcaatattttcttttcttttttttgagacagagtctcgctctgttgcctaggctggagtgcagtggtgtgatctcagctcaatgtaatctccgcctacagggttcaagcgattctcatgcctcagcctccctgagtagctgggactatgggtgtgtggcaccatgcccggctaattttttgtatttttagtggagtcagggtcttcccatgtttcccaggctggtcttgagctcaggcaaaccacccactttgccctcccagagtactgggattacaggtatgagccaccacgcccagccaatattttcatatatagaaatcctttgcttcggtgaactgtttcttcagaatgaggtggtatagagttatgttaataactcttaatgtctggtggacattctaaattaagtattatgcatgtagattttcctacaatctcatcactggggtgattattttaaatttcttttagttaaaaatttgcatttaaatttcttaactgggaaatatttttttcacaaaaatgtttaactatcaaatgaaggattttatactttctggttgttactgtattttcctggttgtattcataaatgtggttgatctctataattttaacgatcagtctttcttcataggatatttgtttctatggaatttcctattaagatctgtaaatgcaaacagtttttctttccttttttttttttttttttttttttgagacagagtctctctctgttacccaggctggagtgcagtggcacgatattggttcactccaacctccacctcctcggttcaagtgattctcatgcctcagcctcccaagtagctgggattataggcatgtgccaccatgcccagctagtttttgtatttttagtggagatggggtatcgccatgttggcgcggctggtcttgaactcctgacctcaggtgatccgcctgcctcagcttcccaaagtgttgggattacaggcgtgagccaccacgcccggccacaaacagtttttcaaaaacagtacagtatagtgagtaaaagcactagcttatgcaacaggttggttttgtgtgctgcagctaacctcaaagttgtaaggattaaattagataataaagtgcttttagtaacatgcctggcacagttcattgattcaaacattgaaaaaaaatttttttaattatacatagtagtgtgtacctttggaaaaattagaacttaacagataaggctaagtttgagccttccagtcctttccttctctgcatactcttcagaggtaactgggatcatgctctgggagcatgtcattccaagtctgtttctttgcttttataaacacatctgtttccatagaaatgctgtagtgtttgcagagggggcggggcttggtatcatcctggatttgttattctgcgcttttttgcttgacctaccttggatggctctctagtcattacagcttttaccttttaactattactcagtattcttactaaggtaagactatgctgatgatgtttatatttctctagtaaaaggctgggcatggtggctcacgcctgtaatcccagtgctttgagaatgtaatcccagcgctttgggaagctgaggtggttggatcacctgaggtcaggagttcgagaccagcctgcccaacatggtgaaaccccgtctctaccaaaaatataaaaattagccgggcgtggtggcgggtgcctgtaatcctagctactcagagggctgaggcaggagaatggcttgaacctaggaggcggaggttgcagtgagccgagatcaccccattgcacttcagcctgggcaaaaagagcgaaactccttctcaaaaataaataaataaaaatatttctctagtaacagccatttttgatattttaatattctgctttttatattcttgttgttacattcttataaaggatacatttttaggccgggcttggtggctcacgcctgtaatcctagcagtttgggaggctgaggcgggtggatcacctgaagtcaggagttcaagaccagcctagacaacatggtgaaaccccatctctactaaaaatacaaaaaatttgctgggcgtagtggtgcatgcgtgtaatcccagctactcggaaggccgaggcaggagaatagcatgaactgggcaggcagaggtttcagtgagccgagatcgtgctgatgcactccagcctgggccacagagcaagactccatctcaaaaaaaaaaaatatatatatatatatatatttatatatatatatatttatattttatatatatttttatatattttttttcttagattcaaagtaaatcttgtgtattatttcttccagcacatcttttgcttcataacttgctgcatcatgtttatgattattattttaaaaagctgttacttctttgaaggaggagcctaaaggctgacagtatctcttctttagcttaataactagtagttctaatttggtattttatactcttagcacaccacacaaatgagtgatgaggaagaggatgatgatggctgtgacctttttgctgactctgagaaggaggaggaagatattgaggacattgaagaaaatactagacctgtaaggaaggctgtagttgctatcacttggcagagttttagaaccaatgacttgtttttctttttattgtgacttactttgtacatcactcattttggcatatttgtcatttcatttacactttggaaaataatggcaagcatctcaaattgcctcacaagtaccactttcttgtccagatgttatgattttatgagtcagatcattcagaatatgtctagttccagagtttgaagaccatagtgctcctgtctctccacccattcacctttttcttattttcgtatttagatttttaagtattaaagtcaagtattaaaaagaataaggaaataaagggcatctccctttgaaggaacattttatgagtcctattccttgggtgagctgtatagggtacatatgtttaaattcatttaattaaactctgttttctcctcagttcaatttctttgctcttgtatacataatgttgttaggtgtccaaagtgaagtgtactagtttgttacaaaaaagcgattcttttgatttctcctgctgtagaaaagaagcagacctacatcgtttgcagatgagctggctgcccgcatcaagggggatgccatgggtcgagtggacgaggagccgacaagtgagccccagccacgttgatggggagtaggggaggagtagtgcagggccctctgctggcttcaccaaaggcggatttctctttttattagtaattactacatatatttattagtaattgctacatataatttaaattgtagcgcttattccttttttggttaatgggctcctttagataactgaacactgtggacccacaagaaaaacgtacatgtacacatgtagataaccctttacatataatttcaggggattaatggaaactccagagaaccatgggcaacagcttaagaattcctggctgaatatttactcctatattttgaacacgtaagaatgtgctatatagcatattctagttataacagggtagaaagataacacaataattctttcaacaaatacaatcctgttatgcacatgagcctggtacgaaagcagaagccttctgccttacaaagagactcttgagtgcccactgtgggcagggccagggagttcagtgctctggtgcagctgagatgaaaggcagatgtcttgctcttagctgtgagttatgaggatgacagacgtggaaagaaccaggatgtgtatactgagggaggacttagtactattaaaactgtgaactgttcttcaagccttaccctcaggagaagcaaaacctcggaagacactcaaagagaagaaggaaaggagaactccttcagacggtgggccttttccctcaattctgttattttaggagcctgttgactaaggaatgttgcttacataattcatgaagtactgctttacatgctgttttccctctgacaaatgggtctgtctccatttacttttctaaagcctctgggctggacgcggtggctcacacatgtaatcccagcgctttgggaggccgaggcgggtggatcatgaggtcaggagtttaagaccagcctggccaacatagtgaaaccccatttctactaaaaatacaaaaaattagcttggcatggtggtgggtgcctgttgtcccagctacttgggaggctgaggcaggagaatcacttgaacccgggaggcagagatggcagtgagccttgatcgcgccactgcattccagcccgggtgatggtgcgagactccatcccaaaaacaaacagaagccttggaaggcatgttttggggtgctgggaggatatgtgggtgtggagtaaaaattcctgtagagatttgatttattagattttacagcaatcatttcttgtcttcctagaattcttagaagtatagaaacttaggaatctcaagcatttgttttcaataaaggatacaccaggccttttcctgcaaacagccatgtcgattacattagacttgtccctgtgtcagtttgcagatccctttgtttattctgcccttccttcccccagattggttggggaatgggtcttgaatgtggcgtctgacccgaatgcttgcttcagagtaaatctagatccagggtgctggcctagagaatgaatgctgtgtgccacagacgtggacagacttgagagtggaggcccagagagtcttttgagggtgtcagtggactgtgccaggggtttagtgtgaaattcatcagactgcctcacactttgttaaatagtgtcagataaactccatgccagtttggagacacagcagatgccaacccgggaatttgagttctggacccatctttaatactccctgcaaaacattgctttctgtttgctagatgaagaggataacttattcgcaccccccaagctgaccgacgaggacttctcgccatttggctctggaggtggcctgttcagtggcggcaaggggctatttgatgatgaggacgaggaggtgagtccatggcacccagcaacactccctgcagctagctgtgtcaggggtccacagggaagatataggctttgcttgtttagtgggggaaaaacagtttctcagttggaagttgcttctattttcatattttgggacattttgaactaagaatcacagagtgagaaatgccgtatccttctatgctttgttaggtgaggagaagatgtgcacgtgttaatgtgaataatttactaggtgattgtttcttgccttatctgttgtcttccacgtttgtttttaattcctggacaggcctaaattattttagggtctgattttgccatagttatcactttgcaactgattttctggcagagtagtaaatatgtagctttaaatcttgtaggttatttttccttaggaatcctcacatgcagctatgctttctcctggttttttgaattctttgtcatataccttatttcaaccagagtgacctcttcacggaagcctcccaggatcggcaagctggagcctctgttaaggagggtaagctggggctgggcagctgcgtctccgtgtgcagagttccaaaactgtctttctcactaggagatggaacaaggttgttcccaagccttgtttctgtgtcaagcaagaagctgttgtttttactgcggtccagttgaaagtaattcatcttcactaattcatgtcttggaaaaaacagtaccatctgtaaacccataccacagtcttgcctctttgttaggagagaactcatagaaagtcaaacaagaaaagtaccctagagcaatgttgaggatggttttcattgaatgaagtttaatttaaagaaacatttttaacattctgtatataagttggagaccagtaattccccaacccagtgtgcattaaaatcatctgtgcaggtttttttgtttttttgttttttgtttttgtatttttagtagagacagggtttcaccatgttggacggttggacaggctggtcttaaactcctatcctcaagtgatcacccgcctagacctggcaaaatgctaggaatacaggcatgagccactgcacctgtccccttggtgcagtttttaaaaaacacaaatataaatatgttttttttttttttctttttttttaacctacaaatgttactcaataggtttgtggtagttcttgggacttgggaattagtgattctaagtgccgagtctcccgggcgcaggcatcagagctgggccttggaggccgctccttgtgcctgctgtgcgggctgctagcctggctctcctctgctttctgctgtccatgttttggcatcagtgacttgcttggtttccccctttgctcttatgtctttatttttttactgatgactcacatgtttttgcggttctttttcacccgttcattctcatccaactggaatgggtagaggtggaactgtttgggggagccccggtcatgctgtccctgcctctgctgtgctcacctcctcccttggtgtcccccagctgacccactgctgtggcttgatgacggtcagcatgctcttccatttgagtcacagctcagattgtgttaatcccaaaaaaaaagtcctgacatcggtagagaagaaaatactaaggaattttaaaatggcttgttcaggaaaaagtagtttcaaaaggtctggtactagctgtgtgttacattgcacgtatttcaggaagaaaatagcaaggaaagttatttcccttgtaaaatggttaccccttgctttctcattctagagtcttcatcatccaaacctggaaagaaaatcccagcaggagctgtttctgtatttttaggtaacataacttaggtttgttttctaaaaactacacaaatactgttttttgcatttcaaaattatcatcttctaaagtctggctggagatgaggaagtacctgggagcttcaaagggctttgagcatcttatagaaagagctcatttactgatattagctcttattctcctagagctcagtggccttggacttttttgtgtttgagcgacctggtgattctccgttgtgagatgttctgtagcagtaatggatggaggctattgggccctgttatgcattttgtggattaactgaaatggaaagtttttggtgggtgataatttttttctgtaaattcaaccggcccacactggctcacagctgtggctgtcttgtcccttcactcacaggagacacggatgtgtttggtgctgcctccgttccatcactgaaggagccacagaagcctgagcagcccactccaaggaaaagcccctatggtccccctcccactggcctctttgatgatgatgatggtgatgatgatgacgactttttctcggcaccccacagcaaaccttctaaaacacgtatgtgttcctgcctccgtttctaggacttcagccagaaaaagaatgttgcctaaaaagaacataagctcacctagttctgtatctcttacagtgccagaatcccttctccagcattcctgtcattgagttgttgtgtctgtacttacataggtgtggtgcctgggaggtctgttttatgacccaatcttttctgctctgtaagctaattactatgattattttccttatagagagctgaaatccttttctgtataatttttgcttgcaatttccagttctgacctttggtattgtaaagttttaatcatcctttcttccagccgaccttagtcaattacatgagcagcaggttgtgtgccggccatttatttcccagcttctcatttctctgccaaaaagctcaggtggccttggtctttcctcagatgatgttttcatccccttggccactttggcattctcctctcttttcctcttaaatgtaagtcctatgtcctgaagtcattcccataaatcatttgtttttaaatgtgcagatgaatcttccaggggcttttgtcaaaatgaagattccgattcagtaggtccagggtggggcctgagaatttacatttccagcaagcttcatggtctgtagatcacacttcgaatagcaagacttagatccattgactgctcttccagaaaagaaaggtagatccctagatccctaaggtgcacatgattttcagcaactttaaaaaataaaaaaggatggcataggaatggatggaactagaatgcatttagaagccggctgtctggactcactctcttccagtgttaggtgtagaaagtaaggatggaagccgaagtgtgagggaaaacgatagcctagttaatctagaaagagtgcaaacggatgcagaatgcacacaggtctcagtgaagatgacaatgcacacaggtctcggtgaagatgacagtgaatgaaggtagtagtgctttttgtagctccacagggctcttacttagtggatatctttgagaactgatttagaatccctagtaaattgatgctgctttctttgacaactcctagtctcttcagacattcatgagtcagtgacctcatttcagcaacacatgccctattcggtacagcagtgcttatggtgatgaaaggttggaaaccacccaaatacttatcagtagagtaagctatggcccttctattcagtggactattctgtgacagttaaaaagaaaggggtctacgcttgttgacttgggaagattttgtaggtacattgagtggaaaacacaaatggtaagacattgttcaaattatcttcttatttatagccttatttataaataactagtgttaattcattagtacatcctttgggggaattagaagcatgtatgctgaactgttcccaatgttcatcttgtttgagtagactggtggaattatgaggggatttcattatttgcttttatctgcttttgtacagtttgattttttttaaagcaggagccaagccttcatttctcagattccttagatgattgacttggtggccctcttaaatgatctttcttcctctagatctctcttcaccttgtaagccagtccaagctactctaagcacaggaaatggctgcttggataagcatgtcagccacgtggataaactatctgttctgtctttcaactgaactgctactatgcactttgaaaaattccaagggaagagtatagttccacttactatttctttataactaatcaagaaacaacataactttttatgtttattctttgggagggaagaattttttaatctgtgaattttgtgataggatgtttgacgttagtgtcattttatgccttggtattttttacaggcaaagtccaatccactgccgatatctttggtgacgaagaaggagatctgttcaaagaaaaagccgtagcatcgccagaagccactgtgagtcagacagatgaaaataaagcaagagcagaaaaaaaggtgagcaggagggaagacttaacgcaggagcattgatctgcagcattttaataattcatccggaacccagagggaagtactgttccctttcacgttcatattgaagaacttcaaacagaaagtggaaagaacattgcagtgaacacccaaataactgccacccagattgatcagttcttagggttttggcaaacactttatggatgtaaaccttgttacatatctatttttttcctgaactatttgcatgtaagttgtttgaactgtttgctgcatggaactgtttccatgtagtcattgtgacattctacccctaaatatttcattaagcctctcttgaaaagacttccatataagcacaatgccattatcaacagctgtgagactaacagtaattctatagtagaatctaatatctagtctgtattagaattgctccagttgccccagaatgtctttgcaaaatcaccccaacaaatagaatacagatttaaaattatctcgcatatagttcatactgcaatttcctctcttgtccccaaaatgccatttacggcagtgatccccaacctttttggcattagggatataaggagagtgcaacctgcaatctagatccctcgcatgcacagttcacaatagcgtttgccttcctatgagaatctgatgctgccactgatctgacaggaggaggagcttaggcagtaatgcttgctgctcacctcacctcctgctgtgcggcccggcttctaacaggccatggactggtctgcagcccagggttggggacccctgctttatagtatttttttatgttttgattttttttttgttctaagaaactcaggattcggacagtgtgtctgcattgcatttggttgtcatgtctctttggtctccttaatctagagcaacacctcccacatctttttttttttaatatccagccacttgtcttgtagaatgtgtctcgtgaatttgcttgattattttcctatgaatagattcagggtgagaagttttggcaagaatacaagcaggcagggttgtgcacttccagttggatcacctcccaagacacatcaggtccactgtctgcctcattcagacacgtttgtcacttggttgttagggtgcccaccacactgcttcattggaaaggtaccctgttctcttttgccattgctcagttgatctctaaagtgatagttgaacacagtgtgaatacctgttctctcccagccttttactcagtgttttgaaaatccactgatgatcttttcttgactcagttaatctgttagcgggcacaaaccactatttttttaattctatatttcttattagttggcattcttctgaataaagttctttctctccccctccttccccgatttttagtattgctttgggatcatgtattcattcttcagtgtagatgataatccattaccatcattcttcttctttttttttttttttttgtgagacagggtcttgctctgttgcccaggctggagtgtagtggtacaatcacagctcactgcagcctcaacctcctgggttcaagcgattctccagcctcagcctaccaagtagctgggactatatgcgtgcgccaccatgcccggctaattttttgtggagacgggttttgcccatgttggccaaaccatcattctttttgatgctcagattgacctgcatttggccagtgtgtgtgtccccagcagtctttaagcccttctgactgcttgtcctttcactgctgtcctgtacagctggtccctcctctttctacagttttgtctctttgtgtcatgtcctggctgtgaagccctgactttctcctgccgaccacctaaggcccagcattcagaacctgtcaggcccgtcaggcagcctgtctttccatgctgtctctcattgcatatgtcccatctgtgcacccattgacccagactgtgtgtcctgctccctgatacaccagatgtgtcctctgtttgtcttgctgttctcttaacagccccctcagcttgctgcctatcacagcagagactccgtgcgttttctcgattgattgagtaaaccctcttttctgggtatcttacgtgttaatgcttaatttttctttttctttttttcttccccaccccccccccacccccgacaaaggttaccttatcttacagcaaaaatctcaagccctcatcagaaacaaagactcaaaaaggcttattttcagatgaggaggactctgaggtatggaattcttttgcttagttgtgggtattagtctatggatatgacatagaaactatttttgaatcaggtttttctcaatagagttataagactttttgttaagtactccagttctttaaaaattatctctagaggcaaggagtggtggttcatgcctgtaatcccagcactttggtaggccaaggcaggcggatacctgaggtcaggagttggagaccaggctggccaacatgatgaaaccctgtctctattaaaaagacaaaaattagccgggtatggtggtgcgagcctgtaatcccagttactcagaaggctgagataggagattcacttgaacccgggaggcagaagttgcaatgaaccgagatcacaccattgcactccagtctaggcgacagagcgagacttcatctcaaaataaataaatgaataaaaaataatctcttgagagcacaggggctttagaaagcaatatgtttacaatacttttcactttgggttggactgtatttacatttcctgggatgaaaatcctctctctttaggatgctcagattttaaactgttcatgggctcatgatgtgatgaggagcttgcaccagagtggaggtcaccatgctacttcctttattcacattctcactaactagaccgtggcttaatgctgtagcagatgggttctggcatagccatctgtcttgtcgagactgagaccactaacagcctctgggaccctggttcataggttgctttggtccctccaggcaccttagaaccacctctcagaatttcactgcttttcctgagtctctcaggcctaggtcgtcttagatccaattttaagttggccttttaggagatcggagacctgtatgagaaatgtaatgggaaataataagccccttttacagaaaaacatgtggacatggcagaaacttacatgtatttcaagaaactgtgggctctaggttaggctgtcatggttgggctttgcactcacagcaaggatgaacatggaaccctttggaagtatagtgattgcccttgacgtaaagaatacctttgaggctattatttcattgaaggcgagtgtacaaaacatggcaattaaccaaagtccagtcaagtcacaaccctgacccctgagaaacagcatgatggggcctccaccgtcttatgctcatggatcccctgtgtcacccacacctgcacctcggggtctttgcaccggcccctgccactctgaggaatgctgttcccagaatccagctttcttcctcactcttcgatttctctgtgaggcctcgctgatgaaatacacacaacaggaagcctgctagcacataccacgctgtgctcctggtcctctttcctatttcactgtttaccacagcacgtgttgccagggacagtgtatatttgcttattcattgtctctacttcccactaaagtacgtgccatgagggcaggactttgtattccctatttgtatccctaacaccccgtccttaatacctgtgcttggcatgttgtaagccatccagtaattgttgattagacaagaaaaccaaatgtgagcaatttcagtgacttacgagatgttctggttatttgttgctatgaaacaagtaactcaaaaacctagtggttcataacacccatagttttgttgtctcacagttcgagaggttgactgggcttagctaggccgttgtcactgagggtctcttgtgtctgaaggtggctgggctgagggtcagctcactcatatgtctggtacctgggcactggggcccctgggacatctctcactagccctgtgtggctcccagcatgtagtcagggaagccggtcctcttacatactggctcagggctgtaggggagagtcctcagagagagcccgatggaggccatgtcgccttctgtgttccagccttggaagtcaacggtggtccttttccttcatttgttggtcaagatggtcacaatggcccatccaggtttatggggagaggccataggctccccttcttgatggtgggagtgtaaatgtactctcagacttgtgtgaaaaccctaccaaaggctttgccccatgtgtgtcatcatagagtgaatgtttttattggatattgttcagattctgaggcaaggagaagtaaaactaaggcagtctaagtaagagttaaagctttggacccaaaggaatgcgtcctgactcctttctctatatctgaagtgtgaggctgaagcttgccctgtgaagtcattttgggggaacatatttgaggtaacggaagtgtcttttcttgcagtaccaagaaaggtatcagttaagggtccgaaactgtgatgttgacatttgtttttgttctttgctttggtttactttcattttcttagaacagcagaaccctttctcttgccattgtgtaacatgcaggaggggcacgggatgcctggaatcccccacgtggcctcttctatctaaataaacccatgggactccggggagcacaggggaaaaacactgtgtggaggagatctcacttagtgaactcattaggtctatatttaggagtagacagcgaccccataattaaaaaaaaaaaaaaactgtccaaagaggtcttagaaatatcttcttgtcctatttaattgttcggctcttgtgtattgaagtttatcttcccaagggaatagatgtcccattttatgtttctacttcatgtaggtcaacttgcaggtctttctttgcaggataagctgatgttttataacattttgaaaatttcttgatttttatattttttagctattttgagatgaaattatactctttttgcctaggctggagtgcaatggtgggatcttggctcactgcaacctctgccttccaggttcaagcaattctcctgccacagcctcctgagtagctgagataacaggcacccaccaccacacctggctaatctggtatttttacaaaattaatataggctggtcttgaactcctgacctcaggtgatctgcctgccccagcctcccaaaatgctgggattatagacatgagccacagcaccgagctgaaagtttctttagaatctatcaggtcttatcctggtttgcaacgtcatatacctatagttaagctaagtagactagcaaacatttaaaaataaagtttaatttgtatttatttaaaagaaataagtcggccgggtgtggtggctcaagcctgtaatcccagcacttggggaagccgaggcgggcggatcacaaggtcaggagatcgagaccatcctggctaacatggtgaaaccccgtctctactaaaaatacaaaaaaattagccgggcgtggtggcaggcgcctgtagtctcagctactcaggaggcagaggcaggagaatggtgtgaatccgggaggcggagctttcagtgagccgagattgcaccactgcactgcagcctgggcaacagagcgagactctgcctcaaaaaaaagaaaaagaagtaagtcataatcttaggagaggagggtgttactaaataaaatagttgtagctccattaatttgggaatctagcccctgtttctttattgaccctgtctaatctctgattctttagacagtaatgggaagccatgcttatatatttatttttttagcatggtgtaggaaattgattcaaaaacttattcctgccttctgtcattcaggtgggaatacagaagcccctgggctctgcgagcccaccagatcctgtagctctcctcctccttagcgccactgcacacaccctgcacagaccctgaggcctatccctttaaggactctgtctgagccaccttccctctcaggaaagaagcctagacacatggcagctgtcatgtctgagtcacttgtgttttatactgacctgatattttaaaaactgatattcctgttaaccagcaactttaatttcaatccaacaggatttgttttcttctcaaagtgcgagtaacttaaaaggtgcatctctgctgcctggcaagctccccacgtcggtttccctgtttgatgatgaagatgaagaggtaaacattgttattgtaacactagataatttagattaggagaaaacggttgttgatgtaactttctacccagaggctcatatactagcaaaaggtggtagggaagcagtcaggctacctgaagtttatataacaaaaatatttctgtttttatttcagtgacttcttccttatattttcctagctgtgcaatggagaagacattagattcttgacgcagttctttttttttttttttccgagttggagactttctctgtcacccaggctggagtgcagtgatgcgatcttggctcactgtaaccgggttcaggtgattctcctgcctcgacctcccaagtagctgggactacaggtacgcaccaccactcccggctaatttttgtattgttagtagagacagggtttcaccatgttggccaggctagtttcgaactcctgatctcaggtgatccgcctgcctcggcctccctaagtgctaggattacaggtgtgagccaccgtgcctggcttcttgacacagttcttatggagtgaaatctacaggttttatttttagaaatctgcctttgagaaatacaattgaccctttaacagtgtggaggttattttgacttccacattgcagtgaaaaatccatatataacttcttacttcccaaaaacttatctactgatagcttactgttaaccagaagcctcatggataacataaacaggtgattaacatataaatagtataatatctatttatatatttttgtattcctgacatatccagcttttccttattttttttatgatatttctaggccacatggtttgtctgcaagatttttcaaattgttgcaaatgtccaaaaaaattttcaacatattactgagaaaacatttgtgtagaagtggacctgtgcagctcaaacctgtgtcattcagggtgagctgtactttagtctagaggatggatcaacatatacccaatgacctacaagaatgttttggatcaagtggagatacaaaggaggaggcagccatgtcctgaccattgtctttctttcccgtcctggctggagagagcacagtggggaagagaaataagagagaagacaacccaaaccttaactctcatgcagtactgggcggtggtgagctcaaaggctttgccatcagacccctgggttcatatcccagctccaccacttgcaaaccaggaacctggggcaagtaacttaaccttccttaagctcatgtggcttaacagtgagtagggtcactgtggcagctgtaactactagtgtgaagctcttgcagagtgccggcacataataagtgcatagtgaatgtgagctctgtcattagcatccccaatggacaccagctcattattctcctggcctgtcctacattaccgcactctccttaaaggagacttcatccaggaagacactcccttcatccatcttcacattccagggctgttcacctgagtttgtccatcctaactcagactcaggccctctgatgcttttgttccccttatctgaataaaagcaccttaataaatataacttttggggagtgcttgaccacagaagaatttacaaatgccattaaacttagtacaccagcaattttatttagtaagctatttctccactttgtataatctctttgaaactaatgagaaacacaagtcatgccttccctccatcccaggtgtatgtctttctgacctgtaaaggagtggagacagacccccagttctctcctttcagccattgttctggtttctcattcgtggagacaacagtgtgagtttctggctgctgcgggggctcccgtgcccatcgcaggctgtaaccacctgaaatgagcagagaggcacttgcccacagggtgactggatggggctcagtttctccttgtacttcatgatctcatttgcatgttgttctcctgcttatatgcagctgttctgccttcgagttctatggtaatctctttcccttctatgggtgcagtgagaaaaggctgtagtttgggatttactagcattttgcggtttttccccgccagagttgttatttgtatacctgactggagacttacttccttaaagtttgatataggaggacatcctatgttttctgattataaagttgtcttacctttctgccatttgcttttctaggataatctttttgggggtacagctgctaagaagcagacattgtctctacaagctcagagagaagagaaagcaaaagcctccgagctctccaaaaagaaagcatctgccctgttgttcagcagtgatgaggaggtgagctgaggtttctgctaaaaaagaggggattatttcatgggatttaagagttaaagccatcccaagtctttttctacctgttttatatctcgtgatgttcagtcaccaaaggcgatgttcacaagattgtcttttctgaaggaagacatttaatgtaatatattaatttaaagatgaatctcttcaaaatggttaggaataagtatgactcccacacaatagtgtatgctccttcaaatgagttaggccggctaggggggaaatgatttctcagccatcgctagttcatggtcgagtcccttagaacaaatgacagattaaccagagaaaagtgtgcaagtttacgtaagataagttttaccagacacaggagccttcagaaagaaaaactcaagagaaacaggaaatcctgtgtcaattttatgcagtctgatgaagaagcggacagttttgggggagcacgattagatgaaaggggtgtgacctgatgggaataagctggggggagctcagcaaggcctgtgtggtcagatcattctctgcatctttacaaataaggaggctcctttcctctgggaatagggaggactggaatgaaggttttatgacctactccagagagggttagaggattcttctatgtcctgcttcagaggagaagggccagggaaaggtcagagagacctttctgcttctgttttctcaaatgccaaggtgtcatattttgaggtagcatgtcccgtataccccaatggccatatatactagtatcttgttaaatgactactgtgtttcattaatttagaactatagttaggaggagttacctattgaggttaaactcctttttgagggagtcttaacaatatttctgtttgtgatctggatagatactaccaaatcagttagtttagttgctaactcaatcagatttagtagcagggaatcagatttagctgtgcagaaaaagactttaaatatgatgatataaaaaatcctgagtattaaacatcttcctgtgttataataattcctcttttttttaacattgtaggcaagttagtagggggtgaagtggatatataagtcatagatatgttcatgtccttactgaaagcaatttaaaaattctgaagcagattgcaaaaaaaaatgtattaaaagcttatgcggccgggcgtggtagctcacgtctgtaatcccagcactttgagagtctgaggcaggcagatcacttgaggttgggagttcgagaccagcctaaccaacatggagaaaccttgtctctattaaaaatacaaaaaaattagcaggttgtggtggcgcatgcctgtaatcccaactactcaggaggctgaggcaggagaatcacttgaacccaggagatggaggttgtcgtgaaccgagatcacgccattgcactccagcctgggcaacgagcgaaactccgtctcaaaaaaaagcttatgcaacacacatgtgaacaagacacaatgaaaaactgctagtaatccttttactacaaaagtctgagtctggcctttagaaagcgtttaaggaattcccacccagctgtgctcatgccttcacatcaaggaactcccaagcatatataatttgtgttttctactcaaatgtatgaatttatgatagattatccagtttttttcttttaaacattgtcagtgattgttccccctgtagcaacagccagacatcagtgtagttgctcctactagagtattatagtggttcagggaaaataaaaacattacctaaagcttggagcaaaaagacatgcagaagaaagacagccaaggttctagaacaggggcgtccagtcttttggcttccctggcccacactggaagaagaagaattgtcttgggtcacacataaagtgcgctaatactaacaatagctgacgaactaaaaaaataaaaaggttcgtgcataaatcccataatgttttaagaaagtttacagatttgtggtgggccgcattcaaagccatactgggctgtgtgtggcccatgggccacaggttggacaagcttgtcctagaacaaaggctgtcaacttcggctgctcattgggatccatggggaacttaaaagagtgctgacaggccgggcacagtggctcacgcctgtaatcccagcactctgggaggccaaggaggtgggcagatcacctgagattaggagtttgagaccagcctggccaacatggcgaaactctgtctctactaaaaaatacaaaaattatctgggtgttgtggtgcttgcctgtaatcccagctactcaggaggctgaggcaagagaatcacttgaacccgggaggcagaggttgcagtgagccgagaccgcgccactgcactccagcccgggccacagagcaagactctgtctcgaaaaaggaaaaaaaaaaaaaaaaaaaaagaaagagaagacctaacgagtgctgacagtggatcccagctccagagattctgaattaatctggttggggtacagcctcgtcattggagttttgtgatactctctagtggatttcagcgtttagtcactgctaaacattgaggagcacttctcaaaccttcatgtttaggaaatcacccaggcaccctgtgaaatgcaggttctgattcagaaaataggggcggggcctgaaattctgcataatctgctgctggcttgtggactccagtttggtttgcaagactctagactccagagatagagcacttatgcaagtgcttgggagttctttgatttgaaggggtgtgagcatagttgagtagaattcccttaaatgctttctaaaggccacattcagacttgtggtaaaaggattactagcagtttttcattgtgtcttgttcacatgtgtgttgcgtgagtttttacactttttttttcaatctgctttaggatttttaaaattaaaatattcttctctggagttggaagttcttgagttcttggtatttttacatttggcttccttcttatagcctctgtaattaatgttgattccctgaaatagacaagtcgcttgtaatacagtgcagaaccacattgggaagagacatcgtggcaggtgttggaggaggaaatcatgagaagctctgtgaggtcagagagcccagctgtctagatttgagttcaaagaaaagtcttaagcatgagctttcttcaagactgatgcactaagtttaatacttagtttaaatacaacttagtttaacaaatataagtttgattttactccccatgttttataatctaaattgccattggagttttttttcttttttttgagacagagtctcgctctgtcccccaggctggagtgcagtggcacgatctccgttcactgcaagctctgcctcctgggttcactccattctcctgcctcagcctcccaagtagctgggactacaggctcccgccaccacgcccggctaattttcttgtatttttagtagagatggggtttcaccgtgttagcaaggatggtcttgatctgctgatctcgtgattcacccgcctcggcctcccaaagtgctgggattataggtatgagccactgcgcctggcctggagttttaatatatattttatgttttaaggaccagtggaatattcctgcttcacagacccacttagcatctgacagcaggtctaaaggagaacccagggattctgggaccctccagagccaggaggccaaggctgtgaaaaagaccagtctctttgaggaagacaaagaagatgatctttttgccattgccaaggacaggtgagatagtcattggaaggagtccctcactccattaccgtggtaacaagaaaaggaatctgatgcacaatctagttcatcgggtgattgctaatcatggatcacatagtgattgtgccagtgagaatgtctttgcttttcaatggcaccatcttttccctcagtacccggaaatgtttgtctttgtggatccttatctgatttcttccccaatcattattttttaaccatattctttttctttgtttgtcagggatttgagtatcttttgtttgtgatttttctctgggctactctaaagtatgtcaggtttggtcaggattacttaaaagttactttaggccaggcacgttggctcacgcctgtaatcccagcactttgggaggccgaggtgggcagatcacgatgtcaggagttcaagaccagcctggccaatatggtgaaaccctgtctctactaaaaaaatataaaaattagccgggtgtggtggcacgcgcctgtagtcccagctacttgggaggctgaggcagaagaatggcttgaactcgggaggtggaggttgcagtgagctgagatggcaccactgcactccagcctgggcaacggagcaagactccatctcaaaaaaaaaaaaaaaaaagttatttgaatagaaatctgctcagcatttaacacatcctgttaggaggaagttccctgtagagctgtgcagtatcactccaggggctgataacccatagccaacctaggtgcctctccccattaatgctggaactgaagctgctaggatattcagagtgagcgtgggctgtggttggtataacatgctgccagattagcttatgggttcagaattacttccctgcaaatactttttttccttttgaaagcctgacatgattactttgaaattcacctgaatgttattagcagaaagaagtaactgattggacatgtaaatcctatgctttggtgtggttaagcgtcatttgatagattcagaagtacctcaggtttctgtctccaaatactcgaatcttgtcaagcatcaccatttctgcattaggcctctgtaacttgacactcggatgcatctttggtctctgatttagaatataggctctggaaagttgatattaaattctgattctgccagttcctgtctgaataaccttgggcaagttacctaacttccctgtgcctcaatttcctcatttgttaaacaaaaataaaaacagcatttctctcatcggtttgttgggatgatgaggtggaatctaaatgtgaaacgctgagcacaagagctggcacattctgagccctcaggtattgccagttagcatcgtgactgcagggaaatagtacattcctttatttttgttgctctctcctgggacattcttcttcctgtgttgcctggccaccttctttcaaaactaagtgtaagtttcttaagaagccttcccggctgggcgcagtggctcacgcctgtaatcccagcacttggggaggccgaggcaggcagatcacgaggtcaggagttgaagaacagcctgaccaacatggtgaaaccccgtctctactaaaaatacaaaaatgagctgggcgtcgtgtcacgcacctgtaatcccagctactcgggaggctgaggcaggagaattgcttgaacctgggaggcagaggttacagtgagccaagatctcaccactgcactccagcctgggcaacagagagagactccatctcaaaaaaaaaaaaaaaaaaaaaggcctttcctaactttaaacagacaagaaagagaagaaatagggagtagagggcagacatggctccaccttcataccccaacaccctcagctgagcattttctgcactgtatccaggttagcttattcccatgagtgtccactacccccaccccacacaaggtcataaatctggcagtctgaaccccatcttgtttgtgggtcctggttccagccacacaccatacctggctttcaggaatgctttctctgctccagatacatcctacctcctattgttcccgaagttgtctgtcaagttttgtgtatggaaagtaattcataccttcatcagatctcaaaagaagctttacacacacaagaagaagttgaggtgaggatgtggaggaattggaaccctcatacactgctggtgggaacgtaaaatggtgtagtcactttggaaagtagtttggcatttcctcaaaatgttaaacatagagtcaccatatgacataatagtttcattcctatgtatatacataagagaaatgaaattagttgttcatataaaaacttgtacatgagtgtttattgcagccttagtcataacagccgaaagtgtaaacaacccaaatgtccatcaactgatgactggataaacaaaatgtataaccatacgatagactgttcttcagcaataaaaaagaataaagtagtgatgcatcctagaacatgaatgaacctagaaaattttatgttacttgaaagaagctggtcacagaaaaccacatattgtattgttccatttatatgaaatgtatagataaaccacagagacagaaagtagattagtggttgccagggcctgtggggcagggggaatggagagtgatggctcataggcatggcggttctttttggggtcatgataatgttgtgcacttaggttgtagtgatattgcacaactcgatgagtatattaaagaaaacattgaagtatgcactttaaaagagtgaatctggattaagaaaaccattgaagtgtacgcactttaaaagagtgaatctggccaggtgcaacggctcatgcctgtaatcctaactgattgggaggccaagtggaaggatctcttgaggccaggtgtttgagaccagcctgagcaacatagagcgacctcacctctccaaaaaagtaaaaaaattagccaggcatggtgacgtgtgcctgtagtcgtagctacttgagaggctaaggcaggagatcacttgagttcaggaatttgaggctgcagtgggatatgattgtgccattgctctccagcctgggcagtagagtgagaccctgtcttaaaaagtaaaataaatattaaaaatagagtaaatacaaggtgaattttatggaatgtaaattatgtctcgataacgctactaaaaaaaagaaatagaagccaggcacagggtcatttcccagtgctaatcctggccctgtgatctctcttggcaaccgtcttcatgacaattctggaaataggcacgtccgctttgattctttttgtgctataggaagtgggagagaatgttctgcttgggaaggctcaggcatcgtgtgccttgcagcggtaacagctgatgaacctgcactggatagtaacaggaaaggggcaacctgaggcaggagggacagaggctggtgatttgttggagtcagatttcatctatttcaaaggtctttcctgtttgctttcaactgtgtaaggtcaactaatggcttgggtgtttgggtggtaggtggattcctgtaggtgcagtctagaagaaatattgttgttatggtttttgtttttttcatcacacttttccttaatttgaccttttgtttgtttgtgtagccaaaagaagacccagagagtgtcactcctctttgaagacgatgttgatagcggaggctctctgtttggctctcctcccacatctgttcctcctgcaacaaaggtattcttcatctcttagtcccaggaaatgtccttgagtttatgctgcatcagtagtggtacttccccgaatcagctcttcatacctaaccttggaggctgagtcttatggaagaccttatttgcctggtttcagaaagagatcttctgattaatagtattctacagaagaagcacacgtgcaaagccatcattcagtgtcaggtgtaggcacaaggaactgggtctcagaagaggcttgggccccattggcatggaattctgctaacattagactaggccagttaaggcaaaatcattccttttatgagtgtgtgtcgagtactaacactggtcctggtttatattagccagtcagtaaaaaggaaggaaattctcacatgtgctacaaaatgcatgaaccttgaggccgttatactccatcagtggagaaatggtcacacaggtcctagtacagttagactgtggaatactatacagtggtaaaaaaaaacccagggtggagcttattgggatgaaaaacatactgcaggccaaaaaaaaaaaaaaaaaaaaaaagcgtaaacacgtaaacatggtgtaatttaaactttacaaaacaagaaatacacatgaatgcctggaaaccggcctgaaagcatcgatagcacattgttaccagtgattatgtccagggaaaggtatggaatggggaacttcatactctcaatgcctttttaaagcctttttaaggaaggcatttgtgcattactgtggaattagaaataaactccaaacaaaaaatatctaggagatatggaagaagacccttcctgttaaatggagttgctcagcttataccagaagctctcagccctgggccagcatgctgcccaccctgggccccaggctccctgctgctgcttctacggggctcctgagcctttccttgggtgctctgtacttacatctccccctttaaggacatccagtggttgtacaattaaaggagtcaggagatctgattggtttttctttgtaaattataaataaactactctggaggataactgagcaataaattaatgaattttggagcctctggagctgtaaaacttctttcaacctatggtaattatgattgttaaataaaacaaaaggtcaagacacacaacttaagtagctgaatagcctacacgtttttgattatttgtgaaatataatcatctttagacaatagtaaataaaagatatttcttgtttacagatatttcagtgtaagttaattgtgacttggttgtaagcctatgttgaccaaaaggttaaaccacaggcaggagaacttaaagaaatgtaatgtgagttttgttttgagccaagcttgagaactactagcccagtaaagagactccacacaaactgagaatgcgtcccagagtgggccacacgagacacagcatttatacatttctgttatatagaaaatgggaaaagggggcagtgaagcaacggtgactttcttaattcagattggtgctcaatgacattgaatataagataaagtaaatatgtggttaatgtattttcctcattagccttttaccctaatgagtacataggggtcgcagttgcagggtcaggagagggatggttgattttgtgctgcctttgtgcttcatccaataggcaggttgtaatcggtgcctgtcagtgtgatatttgacagactctggccttgcaggtgaggttcagctttcgttcataggcccggtttctattacccatatggccaagatgcagccattttagacaatttttttttcttcagactttccttattttctgacacctatcaagaaagtaaatttgaccaggcacggtggctcacgcctgtaatcccaacactttgggaggctgaggtgggtggatcacctgaggtcagaagtttaggaccagcctggccaacatggtggaaccccatctctattaaaaatacaaaaattagccaggcatggtggtgcacgcctgtgatcccagctactagggaggctggggcaggagaatcgcttgaacctgagagatggattttgcagtgagctgaggttgtgccagtgcactccagcctgggcaacagagtgagactccatctcaaaaaaaaaaaaaagaaagaaaaaaacaggaagtaaacttcatgacaaggatgagcttgtcttcaagaagattaaaactggtactttgggtagcattttctgtggtttaaggaccttagttatatatgaaggaagaatatgatttgccatacttaagtctctttttgtctcccctatcaactatttgcattgaattttttttttttttttttttgagacggagtcttgctctttcgtccaggctggagtgcagtggcgcatctcggctcactgcaagctccgcctcccgggttcacgccattctgcctcagcctccctagtagctgggactacaggcacccaccaccatgcccgactaattttttgtatttctttagtagagacggggtttcactttgttagccaggatggtctcgatctcctgatctcatgatccgcccaccttggcctctcaaagtgcttggattacaggtgtgagccaccgtgcccggcctgcactgaatttttatgtagttttcagtgagtccaggatgttccacaaaagccttttcctttgatcacttcagtgttgccttatctcttctgaaattctttatgccttccagtgttcttttatgtcaagttcaatggttttgcactttacttatctcttcctaactaaaaatccccttgctctcttctttcttcattcatcacattttaaaatcatgattagcaatgtccttccttagtttcccaaatctgccttcctaacttgatttaggcattgcctcaaagcacacttcctcgtgtcatatggtatgatttgtatctgtactatactataatagagctttagttttttctcaagcacttgttgataagtcacttgctgcaaaaatgccatgaattccaggaaagtcacaaacctcagtttcctagtccccaaatccctgcctccctgataaggaagagatgagaaatgggctgaagtgcttgcagacttgtattgaacactgagttggtataaaacactgggactgtccatgaaaatatagtgtatagtcctttcagatgaacagacaaacagatgtgtgctagctgttatataagttaggaagaaagtcaaggaagggtcaagtagagagataaatattatgcttattcaacaaagcaactgacacttaactgaagaggacagagaccgtgggtgacatctgcgtgggggccctgcttgaaggatggggaggatttgcacctacagacatcgagggcagcgtggcatggaagtttgaaagtttgcagcgaccttaaggaacagcagggaaaggaggagatgcatatgagtagagggatagaatggggtatctgctgagtgtcatttgcttcatgcaaggagtgctggtttgggttgggagaggacctgatccagcaggtgttttgttttagcaagacaacgctggataatgtcttctagttgaaatataagaggagtgaggcagagagagagactcatgatcgtctggtggcagagataaggatctgagggagggaggcatgggggttgacagacacaagtagacagatacaggtgatatggtggcgtgaagtgtcctgtccacaagtcccgggtggtggtgtttgttgcttctcccttttggtgctaccttcactatcctgtcctctcttccttgatcacatttagctgaagccctaagaggatggtttgggcttgttctgtatatggccatgctggtcagacacacttttttattgttgtggatgtcatgtactcttcttttggtagaaaaaagagactgtctctgaggcaccacctttgctgttcagcgatgaagaagagaaggaggcacaacttggagtgaagtctgtggataagaaggttgagagtgccaaggagtcattaaaatttgggagaactgatgtggctgagtcagaaaaggtggactttttttcttgtatacttgaatgcatttgtctctcgtatgttgtttcaaacacacccaaccccttaagttttttgaccacagaaaataaatggcccatttgtagacagatttgaaaacatagacaagcaggctgtgtccccacagtgcaggaagcctctgcagggcctttcctcccggcccttctccaagacatgtgcgcactgtggtgtgcctgctcctgtctctgtggttactgtcacgtcatggcatctttgctttctaacttgttctcttctgtgcagtgttcctgttacccttggtcctcctttggtccccaagtgcacttgaatttaaatgtcagttttaaggagattttagtttagcatccttttacttttagatgatattggcaaggattacagagtagagtgaaatttctactctttctaaaacactagctttcaagtcctggacggtctgccgtctcttgcaggaggcctgtgggtagttctgctggccacacctgggcatccagctttgtggttgccttcagtctctatatgcctcttttctttctctaacttttcttatacgctgtgtgtccagctgcttaggtctaagatctcccagggcctgtgtgaagagcgttgcatttgcatttgctgctgaggctccttggagctacagtgatacaagcatttcatttgtacctgtgttcctgtgtgaaattctcttcctagtggctgtgtgtggaccccagtcctatcccagtcctggtccacacttgactctgactggttgctgtactgccctctccctgagtgtaagccccttgcggactaggcccagtttgttttgctcaccatcatatctgtagtactggcatattaccttgcacacagtaggcactatgttataaactttgtatttctttaaagaagcatttttttaatagtttgagtactctgaaatcgggatgtacctcataatcaatggtatcttacctgaaatgtgccatttgttgaatgaataaatactgcattttagaattatttcagagattcttcttcaattgcctatacagtgtaagccttttacaatttgagggtctgattttcctgattagatttcccccttggggcttatgtattagttaaatgctacgaattcatggtccactcccaatgattggcacttgtattggttatctttgacacttagaagttcttcctagttcatgagcaaccagtgtgcatcaggattatagccgtcctatcacttgataggagagagggacccatggtcttaatgcttggaaaagttatctttggctacggatgattgtacaagactgtctcttggagcagccaatcaagaattgacctcagtgttttgttacttgggcacagatgtgattcactgtgccctgagtcatgcaaatgtggcagttactgaattaacgagaagcttggcaggctccatgataggatttgtatttccaggtgttacttattttttccccctattattttcattttcaggaaggacttttgactagatctgctcaggaaacagtcaagcattctgatttattttcttcatcatccccatgggacaaaggaaccaagcctagaaccaaaactgttcttagcttgtttgatgaggaagaggataaaatggaagatcaaaacattatccaggctccacagaaagaagtaggaaaggtaagcaaaaagcagtagtggttcaagtctctggatgagataaaagactctcatctcatggttgtcattctgtcatgtgagtttctgaaggaatcttaaccttcaatgtagtgtgttaatgattctgtgcagtcatttagatatttgggaatcttaatcaggaactcttacctcaagtagcagtgttaggataggggattagaatttcacccccctcttctgggatttacagaccttgttgttccttctagcaaaactttgccccttggccagttgtgggatgtaaacagcaggaaagggaagttaggctggagctgtacagttaagtatttctaacattcagtttaagaaaaagtgttgtagatgaacctttcatactgatcaggtgtcagcaaactatttctataaaggaccatataatgactattttagcttttgcagcctatttgggctctgtcataactgcctagctctgccattggcagcatgaaaacagccctaggaaacatgaagatggatgggcatgactgtgttccagtaagttttattaataaaaataggtgatggtcagctgggcatggtggctcacacctgtaatcccagcactttaggaggccaaggtgggtggatcacaaggtcaagagatcgagaccatcctggccaacataatgaaaccctgtttctactaaaaatacaagaaatagcttggcgtgatgacgcttgcctgtaatcccagctacttgggaggctgaggcaggagaattgcttgaaccaggaagtcagaggttgtagtgagccgagatcgcaccactgcactccagtgtggcaacagaacgagactccatctcaaaaaaaaaaaaaaaaaaatagatgatggtcattctgtgaggttagtatgaccctgatattaaaactagacagcgacatcaccagaaagctagatatcctttatgaatgtagaggccaaaatcctcaacaaaaatactactaaacccaattcagcaaaatataaaaaggattgcacattatgagaagtgagatttacccctggaatgcaaggttggttcaacatctaaaattagttgatataatgcactgtatcaataaaatacagaattaaaaggcgcatgatcatctcaacagatgcagaaaaagcttttaataaaatccaaaccttttcatggtaaagcactcaattaggcataggaggaagcttaatgaacttgataaaggacatctatgaaatccctcagctgacatcatacttaatggtgaaagactgcatgcttttcaaccctaacatcatgaacaacacaacaatgtccactcttggtaattctaatcaaccttgtactggggattctaagcaagccatgtaggtgagaaaatgaaataaaaggcattcagattggaaaggaaaaagtgaaatgaagcaatctgtatttgcagatggcatgatcttttatatagaaagtcttaaggaatctgcaaaaaacatccattggaaataaagtcattaagattgaaggatgtaagatcaatatgtgaaaaccaattgtagttctgtaagctagtaatgaacatttactaacttacaaaagttactactagtaactttcttttttttttttttttgcaatggagtttcactcttgtcccccaggctggattgaaatggcacaatcttggctcactgcaacctttgcctcccgggttcaagcgattctcctgcctcagcctcctgagtagctgggattataggcacccaccaccatgcccagctattttttgtatttttagtagagacagggtttcaccgtgttggccacgctgaccttgaactcttgacctcaggtgatccacctgccttagcctcccgaagtgctgggattacaggcatgagccactgcacccaacctactagtagtaactttcataagcaattaccagcttatgaatgaaattaagaaatcagtttcttttatagtaataccaagaagggtaaaatacttaggagtaaatttagcaaaagaagtacaagacttgtaaactaaaatctacaaaacattgaaagaaattaaagacctaaaattgatggaaagacatcttgtgtttatggaccagaaaccttaatattggtaaggtggcaatacttccttcccaaattgatttattgtaatctctatcaaaattccagcttgctttttgcagaaatggacaagctgatcctaaaatttttatggaactgtaagagaccaagaatagccaacagtcttgaaaaggaagaacaaagttagaagactcacacttcctgatttcaaaacttactttaagacaggatggtattggcataaggttaaaatatatagatcagtgaagtagaattgagagtctagaaataaaccctcacatttacagtcagttgcttaaggtgctaagatatttcagtggggacagaatagtcttcagcagatgtgccaggatgctgattatctacatgcaaagggatgaagttggacccattaataaataaactcagatccaatgtaagatccaaatgtaagaactaaaactgtacaactcctagaatctagagagtatgtgagtaaattatcatgaccttggattaggcaaagccttcttagataagacaccaaaagcacaagtgacaaaaatagctaaattggactttatttaaatgaaaaacattgtgcttcaaagggcaccatctggaaagtcaaacgaccacccacaaaatgggagaaaagatttacagatcatgtatttgataaaggactcagatccagaatatgtaaaagacttataagtcaataataaaaagacaaatagcccagttgaaagaagggataggccaggcgtcgtggctcatgcctgtaatcccagcactttgggagaccaggacgggaggattgctttaggctgggagttcaagaccagcctgggcaacatagcaagatcctgtctctacaaaaaattttaaaaattagccaggcctggttgcgtgctcctatagttctatctccttgggaagttgaggcagaagagtcctttgagcccaggagttcaaggctgtagtgggctgtgatcacaccattgcactcaggctgagtgacagaacgagaccctgtctgaaaaaaaataggtaagacagacatctgaatagagattttactgaagaagatagacaaatggccaaaaaggatatagaaagatgctcagcatcagggaagccaaaaccacagtgacataccacttcatacccgggaagaggaccataataaaaaaaaaaaaaaaaagggaagtaacgagtgttggtaaggatgtggataaatggaaattctcattccttgctgctgcaagtgtggaacagtacaaccactttggagaacagtttgctgttcttcaaattcttataacataaagctaccacacaatccggaattttattcctgggtacatatccaagagaaataaaaacatgttcacacaaaacttgaatatgattgctcccagcagcattattcataatagccaaaagatggaaacaatggctaaacataatatagtatatccatacaatggaatattatttggtaataaaaaaggcaaagtactgatacatgctgccacatggatgaaccttgaaaacattctaaataaaataagccagtcatgaaagaccacatattatgtgattccatttatatgaaatgtccagaataggcatatcaatggagacagaaagtagattagtagttactgggggctgggagtagcagtgagcaggaatggataattactgctaatggtttggggtttcttttgggggtgatgagaatattctaaacttagattgtggtagtggatacacagatctgaatataccaaaaaatcattacattttatacgtaaatgggtagattttatggtatatgaatttgatctcaatggtgatgttatgcaaaccaggttggcaggtcatagattgccaatcctttttatagatctaaccaaagaaatagtctatgtttatttctacaaaaaatgttatatgaatttttttgttataccaatactataagcttatttataaatgagagctgcacacagtgaatatgattaatttgatatattttctcccagtctcttactgtgtatggttttgtaatatttttccacagttgtgaaatatttaacattacttgctgtgttaaactcatttttatatgtaacaataataattattgttaatgtgatttattttgttagaagtaagtttttcattagtttttttggtttttttgttttgttttgttttgttttgagatggagtcctactgtgttgcccaggctggagtgcagtggcatgatctcggcccactgcagcctctgcctcccaggttcaaggattctcccacctcagcctcccaagtagctggaaccacaggcacacgccaccacacccggctgatctttgtatttttagtagaggtggggtttcaccacattggccaggctggtctcgaactcctggcctctggtaatccacccgccttggcctcccaaagtgctgggattacaggcatgagccaccatgcctggcctttttgttaagttttaatctgtggctgtgataaggaaatagggatgaattttagaatgtcaggtctggagcattatattatcaaaccaataatgttgatggtaacttttaaatgttagatatctagtaaacaaaaaagggactcactcggggtctgaaagtagggcagaagtgatggacagccataggaaggcttgtggtcgcacctgtgccaggtctttggcctgcagtgcttacaggtgagggacacatacttgaccactctgtgtagtttgtgcttgagtcagctgctgtctcttcttccctttggaaatgagatgaagagaattcattcagttgtatgttttttaccttcaaaatgtttctcattatggaactaatggattgcttttctaataaaaaatttagatactatacgaagtttatataatatatataacctggaaagattatctctaaagcttgtgcatatatatatatatgtgtgtgtgtgtatatatatatatatatatatatatatatatatatatacacatatatatatatatatatacacacacatatatatatatatgtaaactttgtatttataaatatattttctggtatttttggaagcgccatagcattccattttgtcaatgtttcattcccctactgagtggcttttaggctgtggccagccttttgctaatataatacagctgcaggggacatctttgttgtgtccatctttacatatgtaacttccttgagataagttcttacagctctaatcacacatgaccttccctcctgttcccagggctgcgatcctgatgcccaccccaagagcacaggtgtcttccaggatgaagagctgcttttcagccacaagctccaaaaggacaatgacccagatgttgacctttttgctggcaccaaaaaaaccaaggtcagttccaaatggttccccacagtatgacttgttattgtattgggtgctgtctcaacagctcacctagttctctttgtaaattgttttgcttttggatattgaacttgggtcttgtttattctagctgttagagccaagtgttgggagcctgtttggggatgatgaagatgatgatcttttcagctctgccaagtcccagcctttggtaccagccttttgttctcaatactgggttgtgtgggaaagattctgggaaaggaaactaacgtccagttagatgattaaggaaaatcctaggagagtcgtgctgcttcctgctaaatgaatggcaaataacatgccgaggggagcgtgtgtggaggatgcaatgcttagtttctgttgttcctcatcttatgttccctatactaacattaaaacattaataatccaggctctctgactgtactacacatctgtgtgatgtttaaatggttgattgaaagaccattgcatacactggggtggctaaatattcgtgcctttcaggtgcaaagctttgaatctgagttttagcctttctatgtcattttctcccccagccccagtaggtttttgtaagtactctgttttctttttatcatagagaggactcctgtgacagccacagtcttcagaatgctatttctgaaatgctacctttgagttggttcagccctcatttgagaaagtatttttaagactcagaagccaggattgttttttgcattatgatttttccttaaaacttctaagatatttgatgcctttttggtattttttttcttttgaaggtacaagagaaaaagagagtagtgaaaaaagaccactctgttaactctttcaaaaaccagaaacatcctgaatccattcaaggtagtaaagaaaaaggcatatggaagccggaaacacctcaggttagaaatcctctttaaggattttcagctcttgtttgcatcccagtacagagaaattccattatgcagacccacagttatttagacttgtctgcattaaggaggaaacagcaaccagggctacagctttgtcttcactgcacttcccccgagtcatctcccctctcctcactccacacgccagagtttcatgaatctatactttaatagttagtgttttttgatgccatgccagatttgactctgaagtggagttaaggtaggatgaagaatcttcttcccactaaagaatttatttctccctctggatttccttggaatagaattaaaatagaaataaatataaattacatctgatttcctgcctgctctcagtgttgcctctcccgaggtcattgctgttgggccgtactctgcagcagtcttctcagaacgctgtggagctcctcctgggaacagcccaggactggagagcgagtgacagttccacgtgcaggtgtcccagggtgtctcactgaagccttagtgtcctgagccgtaaacctgaggcacttggacgaacacatcaccactgacccttcctggggctcagatcttttgcttttagagccagtgcattaggctatggttgaatttttgtgtgctccttgaaatttctatttgataaccaacatggtaattttgcctgctggtcagttttaggtgctctgataaactgtgactcttgggaatcttactcatcttgtattccttgactccatatctgatctggcagctttccacttatgtgacagaggaggaggcatacgtgaagtagtgctagtgaaacatcaggccccaggagagatttgaatgcctttcccattaaagagctacagaaagtgacagttttgctccatcacagatttatttacaggcataagaaacacttgtctttctgtttcccaaatggatttttaactggatgtaatcttacacaggactcatcaggtctcgctccatttaaaaccaaagaaccatccactcggatcgggaagatacaagtaattaaaacactggaatcttcattgcctgccctgtggcatctataaacttttttgggtttcctactcttgtcagctgctgccaaacatcttctcatctcttcccccgcctcccctcccctgcacctagttgttgtctcctgtgtgctgcgtctttaacatctattctttgagcccagtggtgggcataggtgtaagacgctctgttttaattctgagactagattgggcgattttcctacgtttctctactcctctcgtattatacattatgtgtaccgaatcttgtcatgtgtcacaataaagataatagactgctgtgttgaagaacaaatacagagtttcatttttcttctttaggcaaatttagcgatcaacccagcggccttgctgcccacagcggcttcccagatctctgaagtaaagcctgttttgccagaattggcttttccttcatctgaacacagaaggagccacggtctggaaagtgtgcctgtccttcccgggagtggggaggccggtgtgagttttgatcttccagctcaggcagacaccttacacagtgcaaacaaggtgatgaaaccatctttgcttccttgctctcttcttttaaccagaacatgcatatgcttctttctagtttatcagttgcatacacagcagtctttgactctccttttgaaggaggtgcctcatccttccttcagccgctcccccctccattctccccacccccctcatcctgcacctgcttttccatggcctgcatttggtacatttgcattctgctcagtagccacagtaacgtctcaccactttggctggtgtctgacacctgcaggtttccagcactgccacctgggggtcttctaaccacagagcagatcatgcccctcctgctggcgcttcctcactactccaaggagagcattcgggctcctgggtttggtatgaaacccctttgcaatcggtgccagcccatgtgtgcagcttcctcactagtcacttcacactttccagcctgactccaggcacaccaggtgccactccctgaacacacatggtctgttctgctgctgcccaaggctcctgctgcctcctcaccaggaatgcccctctctgtccacagctgtgcttccacatccccacttctgtcactgtgccctgcactccctgcaccaagttcccacagcagcgacactgtttcatgggatctcctcaatggactgtgaactctttgaagttttcctttcattgtagttgggtttcttgtttctatccagtctcccttctctagaaagctttaactgatctgcaagtaagtgacaggacacagaatgacctaccctgacaaatagattcatttcaaatgtttgcaaacctgtttccttgtgcaaaacaaaacagccttccttttaacgacaattttcattggctttttttttattaagtttaaattggcaactaaaattgtgacattcccctgaagttgacaacacaatcatactttgcccagagtagattgtagcttctcaaaattctacttgattgtatattttggaaactatcataaactgcatcattgctactaagtgattcatgttttgagattatatgaaaagttctgatttctaagccatatttcttatgtggaatatttaacatttgaattcaatgtttattgacttgaagaaaacagcaccttagattacctctctttattgtgtcatgtttctccccgctcctggagcctgaatttagactagccccctaacaaaggttagtaccagaattccccgattctttcttgttttgaaagatacccacgtttctgttgagggtagagtaggggccaagggaggggttgtgagacacagagagccaacatgcctactttccaggtttccagcaacagatgaaactttttgtgtgaaactgaactgaaactgccctgaaaagattaaaaaatggagaactctaaaggattaagaatgacttagtcttggagtactaggagctattaaactccttccttggaaatcattaagaaataacctcttctatgttcttagataatatcttcattgaagtagaccagataaccttacaatattttgagtcactgattctttgccatggtagctttgaacactttattttatcgtcagatcaatgtatgtttttttgccgttgcagagccgtgtcaagatgagagggaagcgtagaccgcagacccgtgcagctaggcggctggctgctcaggagtccagcgaggctgaggacatgagcgtccccagaggacccattgcacagtgggctgatggcgccatttccccaaatggccatcggccacagctcagagcagccagtggagaagacagcactgaggaggccctggcagctgccgctgcaccttgggaaggtggtcctgtgcctggagtggacacaagcccctttgcaaagtctctgggtcattccagaggggaggctgacctttttgattctggggacattttttccacgggcactggatctcagtccgtggagagaacaaaacccaaggcaaagatagcagagaatcctgccaacccaccagtgggtggtaaagcaaagagccccatgtttcctgctctaggcgaggccagcagtgatgatgatctctttcagtctgctaaaccaaaaccagcaaagaaaacaaatccctttcctctcctggaagatgaggatgacctctttacagatcagaaagtcaagaagaatgagacaaaatccagtagtcagcaggatgtcatattaacaacacaagatatttttgaggtaataggacttaacacgtttttgtgtctgttctaagttaaggaaggtatctgattggcttatttgagccatagattatgtctagcttgttgcgtgcataccccatagccacttgcttagtaattataattaggctcttttattaataagtctaacattgattcagaagtggttttttgttttgttgcatgtagaatgtatttcttggctggccatgatcattgatactgatcttggtttctctagtttttacagtttttttatttttatagaatattgttgtaatcagcttcctgggcatgccactcggtgacatggcatacagctccactggtccagcttgggagtttaacctctggttctggggacattggccctggctggagctgacaatgtagtgcatgcaggcaataagactttcagtggcatttgctcagcagatgtttattgagcacctggggactgcaggcacaaggtgaactcagagaagtgctaggctcctcagagctctctgggaagataatcaaatacaaacagggcaatggataattaagatgttttcaaatagtactaagtgtcatgaagaaagtaacctggggcagagtggtgggtagggctgggaggtgctcctttaggcaggactggtagagaaggtgtcactgcagtggcggcatttgagccggggtgagatgcgcgggccaagctgtgcagagatctggggtagtgcatcccaggcagagtgggcagtctcgaggccgttccacacaccctggccaattgcatttccatagcttgttgacgtgtttgagtttaaaaagaaaaattgatttaacattgttttgtatgtatttttggcttaacaaggatgatatatttgctacggaagcaattaaaccctctcagaaaaccagagagaaggagaaaacattggaatctaatttatttgatgataacattgatatctttgctgacttaactgtaaaaccaaaagaaaagtccaaaaagaaagtggaagccaagtctatatttgatgatgatatgggtaagtttggttttctacatctgacctagagaattcttacctttccatcacttggtatttttcctgctaccttttcttggcccttttctggaaaatgcaccccagcgggttcacttcagtgtaatcctgagttaggctgaagataggtaagagatggactaattattttagtgaagtaactctttcctatgatagtcatcaaagaatttgaaggcacccagagtttgatgtttaagtataatttaactttgatctcagtgcacctcaccaatcatctgtgacacaccctgatgttatgtaaggaggtttgatcagaaatgacctcacgtgctaaagtaggctgaggggactgccttgggtgtgatgtggttggttgagtcagagctccagatggacagggagtgtccatggttctgtgcgagaagagagcaagtctagacctgggtgtaggctctacctcaggcgttgcatttcactgaggtctttggtgtttgggaacaagcttgtcttccttatatggcacaacttctgctttattagtagacaaggcaaatgcccgagaaccctaaatattggacttttgataaatcctgtgggctgagccacatacacatttcctactccccccgtcaatctagacctttagactaactgggagacagctggtgctgcagagccacacactggctctgtgcctccagcaagccgtatgctctgtctcccctgcttcccaccacatggaatgcagaagggaactcattcattattttaaatacaaaaaaagtaatacatgcttattgtaatagattcatgcaattcagaaaatgtaaaaagtgaataacccctagaggtaatagtaacagtttggtatgtatcctttcagacacagtgatattaatatatgtttgtgtacacatcaatatatacccacctttttaaaaagtaagaatatatttccctattctgctctgtcttttagttacttaatgtcttttcatgtcagtacgcagagatctccttccttgttttcagtgctgtgcacgatttctttatatttagccattagcctgttgacggcaatctcgattgtttctgttttctttattacaaataatgctgtggtctttaccatttgtgtacacctaactttatgtatacatgctaaaatcatggttggataaaaccctagcagtaacattactgggtaattaccataattagataagacaagcttttgagtcagtgaaacactaaacgaatgcagtgacggaggcttacagtcttacatcgagatgcctcaaatcagtgcatttattctgaaagaaaacaggtgggtcctatattggatttccctttgcatatttttattgctcttttaaaacccagtatgaaaagaatatctaaataagtccattgtccctgatggtaggggcgtgggctggtttggagatcaagttacccttcccttttttctgtcctgcacacgcacatacatacacttttgtagctgaagaaattgtgctccaagagaaacctgtgtgtgatcataaaatttaatgagtaacaaacacagaaccagaatctaagaggcttgagttctaggttagtgttttagggtactccatgctgttacgagagctgggtctttggtggtttgcttgcatgtgtcttaaaagtacctttctccacccctcttcagcaactgtttttcttttttctttctaaagatgacatcttctccactggtatccaggctaagacaaccaaaccaaaaagccgatctgcacaggccgcacctgaaccaagatttgaacacaaggtgtccaacatctttgatgatcccctgaatgcctttggaggccagtagagcacacagggtatccacatgttaccctgcagctacattgttgagttagtgatgatattgtatatgctcatggtcttaactggattacaaaaagcaaatactagaacagctagctcatcttttacccaatgtacttagtatttttctgcactggtttaatcatgcttaatactacaaaacaaaaataaatatttcacagtggttggtttgttttgtttttaaaccacagtttgatttagttagccttgctggggccataatatgcttcagggtgtgtaaaagaagaaatctctttgtggctttcatgggcagggaatctcagagatagcaaatgccacctgaccagaagtctttgttatatggatgggaaccctaacttagggcttgggcaggggaaagagaaagaagatgagagattatacttcatgagtcttagcaatatgggagcaggttttcactgaattctgagggtgcctctgcatgtcctccaaggcaaagtttggcaaactgtggcccccccactgtcatattttgttaataaaattttattggaacacaatcacattcatttgtttacttactgtctattgctgctctcaccctacctccaatgtaagagttgagtgattatgacagagactggatggctcacagagcctcagatgttttctatctgcccctttatatacagtttgctgaccattgctctaaggcatccttttccatccttgtcttgtggaagcagcagaatgaacctaggtaatagccgggggaagtgctgaagatggaaatgtcagcctctagagcagcactgccccatagaactccacaggaatgaaaatgttctttatctgtatcgacaaaggcagtagccactagccacctggatggctgaccccattctaatctgtgttttttggtgctctgtcgtcttgctgctgactatgcagcctgtcaccacagcacagtcttgtaggccgcccaggttggtctcagcgatcgtggagctacttacttcttccttgggcactgtaagatcggaaggggaattactcatacccagagtcaaacattttgtacggcttccacaggtcaaccatttgcccaagtctgctgtgagagtgacgtgataacagataagggcacttgctagttggccactcctttcccctattcattttatgcatcttccttctgtccttaggttgagatctccgagtcgctgttgtcaggcagactgctgtcctccagattcaggcctgtgggtctggggagccctggttggtcttggaggagcaagggctgcgcaggtgacttggtggcctcaagtgtataggtacctggatggtgcgaggagatgctggctctgaaatatttcctaatcccgcttgcggatcaactgccgactagcgtttaggttacagacatattagatggttgatgtgattctgtagctcgtatttagaactttagggatgttttcacatatcagtaaatgaagatctatgtcaacattttttttttttttttgagacggagtctcgctctgtcacccaggctggagtgcggtggcgtgatcccggctcactgcaaccaccgcctcctgggttcatgccattctcctgcctcagcctcccgagtagctgggactacaggcgcccaccagcacgcccggctaattttttgtatttttagtagagacaggttttcaccatgttagccaggatggtcttgatctcctgatcttgtgatctgcccgccttggcctcccaaggtgctgggattacaggcgtgagccactgcgcccagcctatgtcaacatttctaatggtagcttcacattctggatatctttatgttggggaaaaagttttaaaggtaactgctcttctgtagcaaagcttttttagagcagaggatggagcaaattctgagttactgaaattacgtattcagtgctattgccttgtttaccttccatttcatctttggagttgtgtttttagaactttttcagaagggatgagataaatgctttgggaatttatttagaaatctttttggtgtcattactcttaagagctagatatattttttaattgtaaaaaattatggaaatacttttttctctacctgctcccatttttttttttttttttaaagacagggtctggttgtgttgcctaggctggggtgcagtggcataatcatagcttgctgcacctttgaactccagggctccagtgatcctcccaccttagcctcctgaatggctgggactacaggtgtgtgccatcatgcccagctaatttttaaaaaaaaatttttgtagagacaagggtctgttgcccaggctggtctcaaccttcttacctcaagtgattctcccaccttggcctcctgaattgctggaattacaggcatgagccacaatggccagcttctttctgttttctttgtttcctcttccccttctgttttcttcctttttttttttttaagctgttctcgcatcattttccatcccatctttaagtcttcattgccacctcattttccaagatcatgagtcccacagtatgctcagctaagcatgaccacacaccatttcaagaagccgttcatggacccagcttttattactggctgggtctttgttctcctgctgcagcttccatttgctcctcagctaccctctaggcatccagtctggcttaaccagatttcatggcctcattttgtcctctgctacagtgatttctactcctgaggagaagcataactatcttctagagggaaacattttagcttttggttatcaaccttggttcttttgggatattggaaattaccccattgactggacccagacttacggtggaagttccagcacaattaatgctgaacggggttatgctttttcttctggcatatagttgaattatccattctcattataggtgaaggacttccaaatctgtttgttatcttctaccctcccccagcctattattttcagggtctcactatggaagaacactgtggtgaaggaaacaatccatattccttaggcagttatagtcactcatgtctttatttctgtcatgtgcattttgcagtcctgacacctgacttctgttgctagagctgcacctgtgtaggtacgagtactgttggcttcggggatacacacgctggcaactctataggacagtcttatttgatatagcataagtatgtttttaagaattcatgttatccaaaattataaaagcagttgtttgaatgagtgaaagaaagggggttaaggttagagagctccatacaaagtcatatataagcaatgcagctttttaatttagcttttatttaagagcaatgaccctttaccactatcaccagcagtattattagcctggtaccttgtattactcttaatacccatcattttgaaatatggtgcaacgacactcaaatgagctgcactacaagaaacaactttcctttctgtaatgccctccctttaggatcactagaagtctgtacaatgcaatgcagattcccgaattaatgatctttcctattagtgtaattaaaaactcatattatagcagattcctgtatgtgcatgtatgttatgagttggataaacgttggtggacttcatttggagtgaatcagaatgggattcctgtgagaagccaacatccctctaaacaaacttttggagcatgatatggcttggatgttttgtcccctccaaatctcatgttgaaatgtgacccccagtgttggaggtgggcctagtgggaggtgtttggatcatgggggtggatcctcatgaatgtcttggtgctgtccttgtggtaatgaatgagttctcactctgagttcacatgagatctggtttaaaagaacctgggggccgggcaccgtggctcacacctgtaatctcagcactgcgggaggccgaggctggtggatcacgaggtcaggagatggagaccatcctggccaacatctagaaaccccatctctactaaaaatacaaaaattagccaggtgtggtggcacgtatctgtagtcccagctactcgggaggctgaggcaagagaattgcttgaacccaggaggcagaggttgcagtgagctgagatcgtgccactgcattccagcctgggcgacaagaggaagactctgtctcaaaacaaacaaacaaacaaaaaacaacctcacacgtccttcctctctctctctcttgttctctcaccatgtaacatgctggctcctctcctctaccatgattgtaaacttcctgaggccctcactggaagcagataacagcattataccccttgtacagtctacagaaccatgagccaaaataaacctcttttgtttataaattgcccagtgtcaggtattcctttatagcaacacaaacagctaacacaggataaccaaatagttattaatgtctaaaacttggataataccttacctatagcacaggtttattctgaggatcaattgaaagacaaaaatatctgttctttccttgaacaaagctttaatgagtaccaatatgtgcaaaacactgtgctaggtggtagagatcagatgtgctcccttcagtttagtaaaaaatgaaattgttagggaccgggtgcggtggctcatgcctgtaatcccagcactttgggaggctgaggcgggtggatcacgaggtcaggagatcgagaccatcctggctaacacagtgaagccctgtctcttaaaaatataaaaaattagccaggcgtggtggcaggtgcctgtagtcccagctattcaggaggctgaggcaggagaatggcatgaacccaggaggcggagcttgcagtgagtcgagatcatgccactgcactccagtctgggcgacagagtgagactctgtctcaaaaaaataataaaaataaaataaaataaagaaattgttatgggtgcaatatatgatgtaggtagtagtgtaaagggggtaggtataaaagctttgtggaatagttgatattggagctgaatgttgaaaggtgattaggtgcttgtcaggtaaccatgtgtgcacaagacagtaagtagagcagagcaggagcaacaatatagaagctgatgtgttctgaagctgcagatgcagatgattagaggatagaagtaccagagatgttgcaagatgaggtgaggtagtagatgggtaaaatggggccggaatatgaggtgcataatcttgggagcatttctaaggagtctgaattttattctatagacagggagaagtcattatagcgccttgaggcaagaaataacatgatcagctctacgttttgaaaagataactgtgctccacattatgtgtcattagggaaatgcaaattaaaacagcagtgacgtactattacatgactgttacaatggctgaaatccaaaacactgacaacaccaaagctggggaagatggggagcaacaggaactctcattcactgctggtgggaatacaaaatggtactttggaagattgtttggcaacttcttacatattcttactgtatgatccagcaattatgctcctcggaatttgcccaagtgagtagaaaacatgttcacacaaaaacctgcatacagatgtgtacggaagcttttttcataattgccaaaacttggaagcaaccaaaatgtccttcagtagatgaatgtataaataatctctgtactatacccagacaacggactgttattcagcaccaaaaagaaatgagctgtatcaacccatgaaaagacatggaagaaccttaagtgtgtgctactaagtgaaagaagccaatctgaaaaggccgtatactataaaatcccgaaatacgttctggaaaaggtaaaactatggagacggtaaaaagtgtagtgtttgccaagatctgaggggagagaggaatgaataggcaaagcacagaggatttgtagcacagtgtatgtattctgtgtggtactgtaatggtgaatacatgtcattatgcattagttcaaatccatcaagagtgaaccctaatgtaaattacaaacttcaatttatgtgtgaaaatgatgtgtcactgtggggttcatcagttgtaataaatgtaccactctggtgcaggttgtgataggagaaggctgtgggagtgaggggcatataggaacattgtaatttctgctcagttctgctgctcaaaaaaagaaatctattcaaaaaggagccttttcatgtttagactaacttagttcatttccctcctttagttccttcattggtgaggtttcattgcaatgcattctcaagtcgaacataaaattattttagagctttgtgtgacttttccccttgcttaaacatcattgcggaataatgtaaaaatatgataccctaatctagttttcataaacttttttcaaagttgaaaaaaaaactagcatcatggacagatgggttgaaagagtgaacggcaagaatcgaggatcaaaactaggccatgaaaattgctcagttgagagctaatgaagccctaaattaagtcctaatcattgtagatggagtgggtgacagatttaaacaatattaagaggctgggcacagtggctcatgcctgtaaccccagcactttgggaggccaaggcgggcagatcacaaggtcaggagttcaagaccagcctggccaatatggtgaaatcccatctgtactaaaaatacaagaagtagccaggcatggtagtgcatgcctgtaatcccagctgctcaggaggctgaggcaggagaatcgcttgaacctgggaggtggaggttgcagtgagcccagatcgtgccactgcactccaacctgggtgacaaagcgagactgcgtttcaaaaacaaacaaaaaacaatattaagaagtcatattgtctagaattggtcatttctaggtgtcatggggttgggggaaaatccaaaatgattgacagatcattttgagtgatggcatgaaaggcatctctttaccaagatggggactacaggaaagcaggaggtttgtgggaaaaattataagttttgagtacattggatttcagaggcctctggaatatcatgcttatggagtggagattactaacaaaaccaccatctttaaaaataactgcttctttaaacatgcttatattgtagtgagttcagtgatatatcctttggtagaaaaaattgtaaaaaaattatgtatggcacatttctctgacgcttgcactttcatagtgttcactttctgttcacctaggtttacttactgatatccttctcccactctgaggctttgcctatcctgaaatacatctaaacatttacccatgtcagaaacacttcccaactcatcctataaggccaatattaccctgataccaaatccagacagacataaagaaaactacagatcatctcttatgattatagacacagagatcctgaggaaatacttccagaccaaatccatcaacatatgtaaaggttacgtactatgtccaaatgggatttatcccagtaatgcaaggttgatttgacacacaaaaattaatgtaatatatgaataaaagaggaaagaaaatcacatgatgatttcaatagacactgaagaaagcatttgacaaaattcacaccccttcatgattaaaaagaaaccccactaaaataggaatagaagggaagctcctcaacctgataatggttatctataaaaaccccacggttaacgttatacctaatggtttccttctacagtcaggaataagacaaggatgtccagtctcaccacttttattcaatcttatactgaaggttctagagcagggcaattaggcaagaaagggaaataagaagggcatggtggctcacgcctgtaatcccagcacttgggaggccgaggtgggtggatcacctgaggtcaggagttcgacaccagcctggccaacttggtgaaaccccgtctctactaaaaatacaaaaatttgcctggcgtggtggcggatgcctgtaatcccagccacttgggaggctgaggcaggagaatcgcttaaacccagcaggtggaggttacagtgagccaagattgcaccattgcactccagcctggacaatggcgcgagactctctcaaaaaaaaagtgggggagggaataaaagggcatatagattagaaagggagaagtaaaactctatttgtaaatgacatgatcttgtatataaagcttttatatagaagatctttgggaagaactaaataactaaatgaactaaataaacagttcagcacagttgcagtgtacaagatcaatatattaaaatcagttgtgtttctatacgctagcaatgagcaatctgaaattaagacagtgattccatttataatagcatttaaaggaataaaatacttaggaataaatttaacaaaagagaacaaaacttgtactctaaaaattgtgaaacattgtggaggtaaattagatataaactgaaaaatagtacgtatttatggattagaagtcttagtattaagattgcaatactctccaaatctacagacttaatacaatccctgtcaaaatcccagctaacatttttgcaaaatgggcatacttaaaattcgtatggcaattcaaggagtccagaatagccaacaatctaaaaagagaagaacaaattggaggactcacacttcctaatttcagaacttactacaaagctgcagtaattaagatagggtggtactggcataggtagatcgctagcataaagagtctggaaataaaccttcacatttacaaaaaatggatttttaacaaggatccaagacaattcaattgggaaagaatgatttttctgacaaatgatactggaacaactgtttatccacatgcaaaagaataaagttagaccctacctctcaccatacacaaaactaaattgaaattggacaatacacctaaatataagagctaaaactatacaattcttagaaaaatatataagtcaatctttactacttgggataggccaagcttttgaagtatgacaaaagaaaaatagccaaattagactttaccaaaatgaaaaacttgtgtgtctcaatagatgccatcaagaaagttaaaagacaacccacgaactgagagaaaatatttgccatttatatatccgttagtgtttttatctagaatatgtaataaaaaaactcatacaactcaataaaaaatccaattaaaaatagacaaaatatgtgaataggcatttctccaaagaatgtatgcaaatggccaataatcacattaaaatgatgctcagtaccattagtttttaaagaaatggaaatcacaaccacaatgagatactacttcacacccactaggatagctttaatcaaaaagacagaaagaagtattggcaagggtgtggagaaattggcaccctcattcattgttgatgggactataaaatgatccataccatttagaaaaatttggtagtgccacaatttgctaaacataagagttaccacataacctagcaaagctacttcagagagaaaggaaaacatatgtttacacaaaaacttgcagttgaatgttcatcttagcattatatgtaacagcccaaaattggaaatgactcaaatgctcatcaactgatggatggataaacaacatgagatatattgctacaggggactattattcagcaataaaaaggaatgaagtactgatatatcctagaacatgatgaactttgaaaacattatgctaagtgaaagaagccagtcacaaaaaaatcatatatgatcctatttatgtgaaatgtccagaatagaccaatttggagatagaaagtagattagtggttgccctagggttgagtgggggactgggggaatttgggagtgttggttacagggtatggggttccttttagaggtaatgaaaattttctaaagcaaatgtggtgattgttgcacaactctgtgtacatcataaaaaccagtgaattttaggctttaaatgagtgacttttatggcatgtgaattatatttcaataaagctttttttcttctttttttgagatggagtcttgctctgtcacccaggttggagtgtagtggcgtgatgttggctcactgcaacctctgccttcttgactcaagcgattctcctgcctcagcctcccgagtagctgggattacaggcatgcattaccatgcccaaataatttttgtatttttttggtagagaccaggttttgccatgttggccaggctagtctctaactcctgacctcaggtgattcgactacttcagcttcccaaagtgctgggattacagatgtgagccacttcacctggccctcaataaagctatttttgaaaaggtttaaccacctcaccagaaagacgtgtatcatttgtcctagtttaagttcaaggcccccatttacaaatttttcactgattaatagtcttttcatgtcactacatagagatctccttccttgttttcagtgatgtgcacctctgggtctttgcactggctcctgccactttttcgaacactgttctcagaatccagcttgtttcctcactcttcgatttctctgtgaggcctccctgatgaaatacacacaacaggaagcctgctaacacataccaccctgtgctcctggtcccctttcctgtttcactgtttaccacggcacgtgttgccagggacaatgtatatttacttattcattgtctctacttcccactaaagtaagtgccacataggcaggacttttcgttccctgtttgtatccctaacaccctgtccttaataccagtgcttggcatgtggtaagccacaggctcttgtggctatacaacatttgctctgttctcaagtggggtgattctgtcgatgtctggagaaactttgggttgctatgccttgaggattaactaggtgctactgacatccagtagctggaggccagggaggcttctgaacactgtagaatacacaagaccaccctcaacacaaagaatgattcagccccaaatgtcaacagtgctgaggctgagaaaacctgtgttagaccagcactatccaatagaaatacaaccaaccggtcgggcccggggtctcacatctgtaatcccagaactttgggatgccgaggagggtggattgcttgagcccaggagtttgagtccagccttggtaacacaacaagacattcaacaagaaattaaaagattagctgggcatggttacacatgcctgtggtcccagctacccaggatgctgaggtggaagaaccaattcagcccaagaggtcaaggctgtggtaagccatgattgcaccactgcattccagcctgggcactgaggccacacttcctataggctgctcccagccagaaccgagcatgccagggtactagtgccacttgttcctgcaggacaagggaatcctctaacagtcaacagtccaccagagactcccaactgatccggccaaacgttcctagagctgtgctgtgtctcggactcctcctgccctaccttccttcctttcccctctcccctctcacacggcagtctgaaggctctccctgatcactcctggcccctctcttaacctgcacaggtgcatccccaataaatctctgctgatttcattctaacttggtgtctgcttctgggaggattcatactaacacaggtttcaaggtcagacagcattcaaatcccacttccatcacagaacctgagccagttcctacccctttctcagcctcagtttcctcagcagtgaaaagaatattgaaacagaaactctttgaaagctcttcctgtcctgatctgttccagaatcgggctcagcagggttcatgcaaggacacaagtgtagctgcctctgaggagcccctcacatgcccattttagccagtttgtttctccctgggctcctacagcacatgtgcccatcacacagggttgcaaacaccagttttcttctctgattccccaaagggtgctggacacctgtagaggggctctgttttggtcacttgtccatgatgctcagagaatgtttacagtgcacagtgaatgccgagcactggaaatgctcagtgaagcaagccaacaccagccccaccagatgtcagcaaggaggagttctgtggctatagtctctttggttccatggaaatgacaccaacaacccacataattgagggccctgtgcaggtgccgggttcccagcaaaagtctttgcatgtattttctgttatatgaatcctcctggcatgctcattgagaggttccattactacatgcccatcttcataaactaaacatgaataaactgaggctcagggaactggagttgatggtcccagcctgcacagctaggaagaatcaaggggtgagttttgggttttattttgcatatttcagcagctttactgaggtataatttacacaccataaaatttactcacaataaatgtacagttagatcagcaaatctatagatttgggcaaccatcagcacaagccagttttagaacatttctattaccctgaaaacatttctcttgcctgtttgcaggcaatcttccattcccacccccagccctaggcaaccaccaatctgctttctgactctacagatgtgcctttttctgcacattccctcttagtgaaatcatatactgtgtggcctttatggttggcttctttcacatagtgtaatgcttctgaggttcatccacgttgtaatgtccattgtggcttcatccctgtctattgacaaataaagttctgtttcatgggtggatcacaaacgtctacatatccattcttcagctggtgcacatttgggttgtttccagtcttgagccattatgaataatgttgttatgaaaatgtgtgtataagtttttgtgtgagaatatgttttcatttctcttgggtagatccctaggattggatttgctgggtcacatgatgagagtaagttatacaagaaactgccaaacttgtctatgtaaattggttgcccaccagcagcatatgagggttccactgctccacacagtagggctgagattggaggcaagtccagcccgaccccagaaccccattacccagctctttggtgatcctttctaacattgggatacccagctaaggaatgaggatcatagctgtgcaggaatgagggctgtctgtgaaaacaagaagtgctcctgcaccagcccagacaaagacccctcacttatctcatttatttcttgtcctccaagtgatgctggagcccctgggtttccccacatgcaatccctcaaatttctgacccctgctatttatcttccattgagccttaggttccggtgagagtaacaaggatagacaagggttcacagcccagggctagggatgccctataccctggtcagtgaccttggaagggctgattcagctggaactcaatattgaagcacctaggatgtgcctgtttacacacagaaaaaagataatgcagaagcatggggtccctgattagctgatctgagctggggtggggcttggcaatcattggatccagtgcttttcctgaaacatgagcattgagtttcctgcccacacaaccctgggcttaattaagtccaagcaacaaacagggtcctcagtatgcttaaaggattgacattggatggaagacaattcaatgtttgagaaatccctgcagaccctctgggagtgtcttgaattctaaggagaccatcttgccctacttccttatttgacagaaatggaaaactgtggctcactgaggtggagtgaaataccccaggtcatccagcaaggtgagggtggagcaaaggcttggtcccatggcatatattcatccatctccttgcccatccgttgtcttccagcagaatgtaagctctgagaagataaggattttcctctccttttctacaactgctgtcttccttgattctagcacagtggctggcacaggttgggtgctcagtaaatatctggtgaatgggccaggcacagtggctcacgcctgtaatcccagcactttgggaggccaaggcaggtggatcacctgaggtcagaagttcgagaccagcctggccaacatggtaaaatcccatgtctactaaaaatacaaaaagtagccaggcatggtggtgggcacctgcaatcccagctacttggaaagcagaggcaggagaatcgcttgaacctgccaggcagagattgcagtgaaccgagattgtaccactgcactccagcctgggagacagagcaagagtctgtctcaaagaaagaaagagagagagagagagaaagaaaaaaaagaaagaaagaagaaaatgaagaagaaagaaatgattctaagttattgtttttaactgctgcagagtattctgtggtaggaacatacaatagttcatgtagttattctcccaatgatgaacctttagatcattgccaatatctcactgctaccagcaatgctgctaagataatcttgactatactttcttgcacacacatgcaaatgttttggttttaacagatatgtcagatgccctccaaattgactgtactaatatgcactccctttggtgggacatgagggtacccgtttgtccaactctggctaacatttgttatcaaagttaaaaatacttgccaatctaatcagtaaaaatagcatctcaatgaccttttatttgtatttccttgataaatggtgagatcgagcattttttctttcttagcaattttaatttccttgaatagtattttcatatgaattgcctatttgctattcatttgatttttttcttattgcccatttattatgaacactcatttgtttggactttattatctttgtgtctttttttttttttttttttttttgagatagagcctcaccctgtcgctcacgctgaagtacaatggcatgatcttggctcactgcaacctccgactcccaagttcaagtgattctcctgcctcagcctccaaagtagctgggattacaggtgcccaccacgaagcccggctaatttttatacttttagtagagacagagtttcaccatgttggccaggctggtcttgaactcctgacatcaagtgatccaccctcctcagcctcccaaagtgctgggattacaggcatgagccaccatgcctggcctatctttgtgttttttattgatgatgctctgtttctctttttgtccccattcttgttttctgttgggttgattgaaatttctttgttccatcttatttccactactggtttgaaatttatacatttcattgctatttttctaatggttactcttaattttttatatccatatataatgttgcctaacaaaatctgaaggtaaactgtacatatagactcttcccaaacaagataagaaatgttcacttcctccccctgttttcctttttcccaagtctcctgttgatataatccagaattctaattccaaattgttattttaagcatccatggcaatcaatactttagtcttaaataatagcattggctgattacttagggaagtgttacttttttcgcactccttcttcctctggtttcatgtcatttcttgcaggagggcttcttaagtagttgttttcaacagaatctgttggtggtaaactttcttaaatcttgaatgttcaaaaatgcctttgggccgggtgcggtggctcacgcctataattccagcactttggtaggccaaggtagtcagatcacttgagcccagaagttcaaaaccagcctgggcaacatggaaaaaccccgtctctacgcaaaaacaaaatacattagccaggcgtggtggtaggttcttgtagtcccagctacttggggggctgagatggaaggatcgcttgagccaggaaggtcaaggctgcagtgagccttgatcatgccactgcactccagcctgggcaacagagcaataccctgtctcaaaaaagaaaaaaatggctttgtttcactgtgcccttaagtgattctgtagctgggttatagaattcagcatcaattagttattttccaaagctcattgaagacatggcttcattggcctgtatctagtgttgctaatgaaattaatgaggaaaatctgatccttatttctttgaatttaaactatttttttttttttttttttttttgctttggtagcttttaacatttttttctctattttcatagctttcttcacttttggggaatttttagctattaattaaatactactttctcccattctctctctgcctttggaattcctactagacgaaagcttgaatgcggtcacccagactttctggctcttaaccttttcacctttttctctttgttctttaacctgcaagactccctcaactgaatgctccattttgctaatggacccttcagtgtgtctctgctgttactcagcctatcttttgaggtttttctttcaataacttgggctttaatttttgagatctctaattggttctttttcataattgcttggttttattttcccctgttttgctgaaggtattaaatgtacttgctttaattgacctttggttgtagagaagatttttcatttgctctatttgttatttctctttcatagcagtgggcttcctcagacatctggcacttcttcaatgcacactagatttctggtttccaattctccacctgagtctcaggattctgcagcattcccaggtgggtgcagactcaggttacctgggccttggcttctcccatggcttcttaagaacttccttgtttatttctgtgatcccaagcactcccctttatgacttcaagcccaattgtatagtcagtaatttaatttctctatctgttctatcatttataagggcacagcatggaggggagggcctttcagatatttttcttgccccatcttaaatccctaaattacacttaaaaaaataccaccaaagcttttgtcttttatttaggaagaatagagtactcagacatgagtttggagtaggcgggtgtatgtgtgtatgtgtgcctatgcagtttaaacctgttctgtaatgtattgcaataaatgtttcagtgtcggtacagtgaacaattcaacttcataataggccaatctggaatctcccagaaaaatttactttgggtgttagtgctttttttttttttaatcattaatatctataggaagacctagtaggagtggctgacaaagtttaataaatctcatgataaaatgcttgtttttgatgtgaatgttgttcctcagtccatcctaaaatgaaattcacagggttgggttcgatgtcttcttccacacctctcattacaatctgccataggagtgcagaccgcccccatctgaggcctggatttaatgctcaaacaagacagatgccagcaggaaatatttgccctgccttcgctgtaaatcttgagtccttgtccatgatatcctaaaaggccaccagatggaaatgtgatgccgtgaaaagagatgcactaccctttgcaaagggggattgaccctgctgctctctcaaaagaaattgtccttattcaatgtaaaacaaggttttagaaatttttctttgttgaatgtagaataaagagggcattacatgaatgcctatgcatttcagctttggagaggaatccttacatccattctgacagcatggagataaaaagtctgtctttctgtattcatgttttgttgtcatttgctttcttttctcccttcttggtctgtgtgtaccacatcctctctatgtcttctctttctttcttttttttttttttgagacggagtctcactctgtcaccaggctggagtgctatggcatggtctcggctcactgctacctccgcctcccgggttcaagcaattctcctgcctcagcctcctgagtagctgggactacaggcatgcaccactacacctggctaatttctgtatttttagtggagacggggtttcaccatgttggccaggatggtcttgatctcttgacctcatgatcggcctgcctcagcctcccaaagtgctgggattacagatgtgagccaccgcacccggcctatctcttctcttttttgtcctctcctttgttacctggaaccaacttttcatccctctggcctttgtctcttcctattttctggccatatgtggatcagaaaaataattataaaaatgatttgttgttttacttactacaaatgtatgatttctgttttcattgcaaaagccaatgggtaagaatttttaccattccttcactgtaaaaaataaaactgagggccggtggcggtggcttatgcctgtaatcccagcactttgggtgaataaggtgggcggatcacgagttcaggagactgagaccatcctagctaacacagtgaagccctgtctctactaaaaatacaaaaaaaaaataaaattatcggggcgtggtggcaggtgcctgtagtcccagctactcgagaggctgaggcaggagaacggcgtgaacctaggaggcggagcttgcattgagcagaaattgtgccactgcactccagcctgggtgaaagagtgagactccgtcttaaaaataaaaaataaaataaaaataaaaaataaataaaactgaggccaggtgtgatggctcctgcctgcaatcccagctacttcggaagccaaagcgggaggattgcttaagcccaggaggggttgaggttgcagtgagctatgattgcaccaccgcactccagcctgggtgacagagcaagatccttactcgaaaaacaaacaacaaaacaccaaacaaaaagctcctgcattctgccaaaactaactgaataattttaaaagtattttattgagttataataatccaaccaaaaattgtacctattataactgtatgtctcactgattcacaaataaaaaaccacagtcatttaaccagtactcagattaagaacaagaacattacctgtacgcctgaaacccccatctgtccccatccagtctctaccttcctcttacccaaggacaatcatcacccagacttctaatagcacagaataatttcacttatttttgtgctttataaaaatggcatgaaacgtcctagtttgggttcccctaggagctgccctgagacaagtatttggcgacagttcttttatctggaggcacagggaacactgagtggggcatgaagaagtgagccaggaaaaaggcaggcagcagccataaagaaaaatgtgttaccaggccaggcgcggcggctcatgcctgtgatctcagcactttggaaggccgaggtgggcagatcacttggggtcaggagtttgagaccatcctggccaacatggtgaaaccctgtctctaccaaaaatcaaaaaattagctaggtgtggtggcaggtgcctgtaatcccagttacttgagcagctgaggcaggagaattgcttgagcccaggcggtggagggtgcattgagtcaagatcacaccactgcactaacagcctgggtgacatagagaaagaccctgtctcaaaaataaataaataaataatttttttctttcttttttttggagagacagttctcactatgttgcccaggctggttttgaactcctggactcaagcaatcctcccatctcggttctcaaagtgctgggattacaggtgtgagccaccatgcccagacattttcatcattcattttttttttttttttttgagacggagttttgctcttgttgctgagactgaagtgcaatgtcaccatcccggctcactgcaacatccgcctcccaggttcaagtgactctcctgcctcagcctcctgagtagctgggattacaggcatgagccgccacacccagctaattttgtatttttagagtacaaggggtttctccatgttggtcaggctggtctcacactcccgacctcaggtgatctgcccatctcagcctaacaaagtgctgggattacaggcatgagccactgcgcccagcccattttcatcattcctaatagccatggagcattccatttaatcaactgtatatgcatttttttttccgggggcaaggggctcatattcacacacatgggaggccagttggtgagaaggtggcaggcggcatagccaccttatacagcatgccatactggtccactgtcagaccggtgatggccacagctccatcaccccccatgctgactctggctcctgcctggctctgcccggccaccacaacccctcgggaccattcagaggcatcactggagggtgtgtggttagtggagcagctggtcatggggaggtctcgtttctttggtggaaggcattcctgactcctctcatgaacaggtttcatattgctttgtggtgttcctggagcctggaaggagttggcttgctccctggggcatcaggaggggcttctcggtagcttccctgtacccctcactgcttctggctggggcgcccacatctgagcttccagtggtgcttctgaacagctgtagtaagcgtcctcccggctggctcgggagccagcccgtttcacagcgcttcctgggatccacccgctcatcctgcagccgccgcaactgcagccgccgtcatcccggccctggagcccccacacacccctgtgtatgcaatatttgttaaccattcccttttggtgcccatctaggtacaggtctcatttttcaagctaaagtatctgtaatacactggaagtaatagatgtcacctccatattgtatgccaaacctaataagcagagcaaaacttttcatccaagtgatttggttaacattttaggatgtttctaatctctcagtaatacaaatatgctacaatagatctgtgtgcttatcctttgggcacttgtgtgtacctgtgcatacctggagaataaagtcctgtgagagaaactgccatccaaagagggtgtttcagtctgtactgccaccaacaatgtgctcgtgcctctgagcttgcgtttgggtcaggagaatttgaaagtcatcaggaaccaaaccaggatataaggttcagctgcagctggaaagtggcaaacgttccaaagctaagacattggctattcctgggctgttcacaaactgtgaggccaattctagatgagatccagaaaaagggtgagcagctcacttattttttaagcaaaacaccttttcttctcatttctgctaagaacaaatagcttccagcaagataaataggggatgcaatatttttacaaattatttctttttttattaaaaaaaattttaggttaaatgcgacttaagatatgtttaacctctatgatactgacttgctcatgagaagaaagagagagggccaggcattcttgcccactactacccactatcaacacttaggcctgacatcagtctctaaataaatattctgggccaggtgcggtggctcacgtctgtaatcccagcactttgggaggccaaggcaggcggatcatgaggtcaggagatcaagaccatcctagctaacatggtgaaaccccgtctctactaaaaatacaaaaaattagccaggtgtggtggcgggcgcctgtagttctagctactcaggagactgaggcaggataattgtttgaacccaggaggtggaggttgcagtgagccgagaccatgccactgcactcctgcctgggcaagagagcgagatcccatcttaaaaaaaaaaaaagaaagaaaagaaaagaaaagaaaagaaaaaaaatcaacagaggcttctaggatgactgagcagtgactcagtctctccttgatcagattctgtaaccatccagcagaaaagtttacctgatctgtgggagaacaggaagcagctcagtgggggccttccttgctaaattcttcatcaagctggtctgttatctgccctgagtcctgcaagaacatctcaagaaaaatcccaaaaacatgcaagacaaatgaaggtcctcccttagcgtgttcttgaagcactgaggtgcctgaaaactatatatactttctggggaaacagttttttaggaaatgtagcacagacactaactattcttccaggagagccccttcctgacatgaaagatcttagcatgagagagaagcatctgattcatcatggggacatatccaaccagcagcaggggccccagtgccggtgtccacctcagcagaggagacacaggggacatgaaaagtgtttccattgaaaaaaacttcacctagggtgactatagttagcaggaatgtattgtatatttcaaagtagctagaaggctaagtgtggtatcccatgcctataatatcagcattctgggaggcgcaggcaggcagaacacttgaggtcaggagttcgagaccagcctggctaacatggtgaaaccccgtctctactaaaaatacaaaaaacaaaaaataaaaaattagccgggcgtggtggcctgcgcttgtagtccaagctactcaggaggctgaggcaggagaattgcttgaacctgggaggcagaggttgcagtgagccgagatcaagccactgccctccagcctgggcgacagagcaagactctgtctcaaaacaaaaacaaaaacaaaaaaacaaagtaactggaagaggggacttcaaatgtgtccaacacatagtaataccaaatattcaaggtgatggacaccctaaacaccctgattgatcaccacacattctgtgcatgtaataaatactcaaatgtactccataaatatgtaaactattttatatcaataaggaaatactttgcctagcgtttccatccaaatgggaataaatccagggctctacgtacatatttcatggctttttattgagacttgggaagggtgggccatggtagcaggtgcattcactgtccaagtttgcccagactctctgctgcatgggtgatggcatttgtgactgtgttggtcactgtctcagtgacttccttcatctttttgtcccctgactcttgggctttctttatggcttcggcaatggctgttggaaagaaagaagaagaatgtcctagtgatccacccactgaacttgtatccccttgagtggcctgtgggatgtggccatcttaatggattagtccatggagtggcccaatgggaccaaggggagcaggactcctggcagaatgaatttgaatttggttttaatttccccaacaacttgtatttcttcaactctgagactgagcatctactcatgggtacattgcctgcttatcctttttttctggaaaatgcctgcttatgtcttttggccatttttatgttgggttgttatattgcattatcatttctattacaaatatttttcatagtttgtgatttttcttttggcttggtttatagtattttttttttttttttggctatagaaaattttgaagttttggattgtcaaatttatttaatatttcctttatggctgctgggttttttttccatagttctaaagattctcccctctccaagattaggccaaagtctcttatgttattactatgtctaaatgtttatgatgtcttccccctcaagactcatacgttgaaatcctcagctctaatgtgatggtattcagaggtggggcctttgggaggttgaaattagcacccacataaaagagaccacagagagctagctccttccacaatgtgaggacacaactaggcccatccacgaaccaggaagacgccctcaccagatgccaaatctgctggagccttgatcttggacttcccatcctccaggagtgtgagaaataaatttctgttgtttctaagtcacccagtttatggtttgtttttgtttttgtttttgagacagagtctcgctctgtcacccaggctggagtgcagtggcacaatctcagctcactgcaacctccgcctcccaggttcaagggattctcctgcctcagactcctgagtagctgggattacaggcatgtgccaccacacccagatgatttttgtatttttggtagagacagggtttcaccatattggtcaggctggtctcgaactcctggcctcagctggcccacctgcctcagcctcccaaagggctgggattacaggcatgagccactgtgcctggcctatggtattttataatagcctgagctaagatagttatctcctataagttaataaattcatgtatgtaaatttcagtccttcatctacccagaatctattttgttgaagaggaatgagatatacacatgcttgtacatagttctactcatagctcacacacatcaatttgacatttaacatataattttacatgttaaatgttttgtcccagtgtgctgtcacatagtcttttgtgactttgtcttcttatcattccatggagagaaccatctagacagtgccctaacatagtacagtctgtggcctctgatgaacatagataactgtcccagccgagaggctctgaaaggctgcaacattaggtgcagagtttgacccggttagtcaaagaacaggttggcccagcacctagcttcccttcctccctccctccttccatgcccgacctcagccagctgtacctttctctccagtctccttggcatgtcccaccacctccttcaccacttcctccatggcatgaactgaacagaggagacaagtccagggtgagggctcagagcaggcccgctgcccccgagtccaggatgagggctcagagcaggcccactgcccccacagcccagggtgagggctcagagcaggcccactgccctcctgagtccagggtgagggctcagagcaagcccaatgccctcccagtccagggagagggctcagagcaggctcatgtcccctgagtccagggtgagggctcagtgctgacccatttatcctcacaatggacctatacgtccctggacatccaaggtggggctccgggatgccacccccagccaggacagactggctcattagaaggaacttcccccacagctgccttcatttggagatgccgggacactggctgatgggagacaagctcagtgagccccatgagggcatgggcccctgaagccccttggccctgcccagcctggaatgtcaatgatcagactgtcttgccagctgagacctggagaccaggctaggcctctgtgccagattacatccctctcaggatgtgctggcgcctgcctcaggttaatttccaaagcctcatccagtaaaaccatgtctctcaaagcaattcctccaacaagagggaattctctgcctacttcagagttttttaaagtgtgggtggtagtgtgctagaactgaaagattttggagtcagaagaaatggttcttattctaactctcccttccacctcttggttccctcatctttagaatgggaatctgttgggatgatcagagccaacaccaggtcgtgggggcaacaaagtcccgcggagtcaaaagaatgagaaaaagttcaagagagaaagtgggaccagggggccattgccagtgtggaggctgcaaaggcactgagctctgggagcccatgctatttattggtgatctaacaaagaaacaggtggtgaggatgtggaggttgaaaggaaacagtgtagcaagtgaatgagaaatatatggctacttgagataatgggaatgctggaatcaagaagccagcaagtctagcagacatgcaagccctgcctcagcttctctaccaacactcagcttttctcccaacaggaatcatagaaaactcagaggctagtgaaaggttaaagcaggtggttatcaccagctgcagagtcaaaaacaaaatacacatctgctgccatgtagaaagaggacacaaactcaggcaaggctgtttttcacatgatgacccatgagtggggcctggctgggcctccccacacacagctgctgacctctgcatacaaaacatgcttcggcccagaagcacgccagcattcacccacctgtgggtatcagtcaggctcctggtggaagccagaggacatattcgaatgggtacttgaggaaaaggggctgttcacagaagtgtggacagagttaagggaaccaatgagagatgagaaatgccctggaccagcaagagtgggagctgttatctccctgggtctagagggacaggaaaggtgtccacagaccccgaagagagctgtggctgtaggggaggatcatcaggagctgcagccatcactagaaagatgtggccactggcaaaccagcaaggaagaatctgagtgaataaccacctctcctctctctcccacctcctatgacatcccccactgtctgaattccactagggccagacagtgaggaaccttggtgatgcagtccaagagggagtgggcagagaggagccagtgggtatggaggggaaacagagaaacagagaattccagctcactctgcgggatttctgggtctgatagaaacatagcagcagcttaattattattattttgagatggagtttcactctttttacccaggctgaagtgcagtagcgtgatcttggctcactgcaacctctgcctcctgggttgaagagatcctcctgcctcagcttcccgagtagctgggattacagggacatgccaccacacattgctaatttttttattttgggtagagatcaggtttcaacatgttggccagactggtctcgaactcctgacctcaggtaatccgcccgcctgggcctcctaaagggctgggattacaggcatgagccactgtgtccagcctgcagcagctcaattttacagtgtcccttttctccttctggaaactatatagagcaacaacaagactgaggaggaggaggaggagaaggaggaagaaaaagcccatcatcaacatacacatcaaactcaacttcagagaaattaggaagctgggaagccacgtaaacccaaaagcaggtgacaccagcagaaccaacacaggaagccagggaagtgcagaagaacagggcatggggggccacccagggggaatcttcactgttgccagcaacacacactcccagcaagagaggaccctcagagtgagaacgcagagctggagaagtgaagaaaaaaggaacaggtggtgtgcggggaagtccaggggtgcgggatctgacagcgtcccttcccaagagaggcaggaacacttgggaaggcagggctgagtccctggaggctgtatccgggaaaggaagctggcagtagaaccttcctgaagccgagttggttctgagaggcagaggggcagtggtacaggtgaggccgacgcttctgtgcaggaagggcaggctcctgaggaagggagccccgaatgctctccactagattcccagggagtcccactccctccacagggaccttgcgctgacatctgggaaatgccattcatactggaacctccgacacactgccatgaatgtgagggtttcgtgactgatggggtaggtttctcttttccaattcaatagtataatttccatttattcctcccccagcctccctgaacattcacatcttagatagccacagtacggtgatcagaaccaggaaatccacattctcatatttaactatattaaaattatttcacaaaataaccaattttgttaatttaaatacatttaaatgacgtttaaatgtatttaaattatttaactatttaaaaatgaacatattagctaaactaaagaccttattggagttttgccactttttccactaatgtcctttttctgttcccaaattccacccaggatcacgctgcatttagttatttctcagtctctcgccgttttgtaggactgcaataacagttcctcaatctttccttatctttcataaccctgacatcttgaaccagtactgatcactatttgtcaaatgttcctcgatttgggtgtgtctgatgtatttccatgattggactgaagttacacacttttggcaattacagcacaaaaatgatgtggaatccttcccagtgcattccttcagagttatggcattgatagttcttcttactgatgatgttgaacttgttcatttggttcaggtttctgctggatttctccattgtaaagttactatctttccccctcatagggggaaagatcttaggagaaatacttggagactatgaaagttttgtattttctcaaactttaaaattttttttcaggccaggcgcagtggctcacgcatgtaatcctagcactttgggaagccgaggcagatggctcacctgaggtcaggagttcaaaaccaccctgatcaacatggagaaaccccatacctactaaaaatacaaaattagccaggcatggtggtgcatgcctgtaatcccagctactcaggaggctgaggaaagagaatcgcttgaacccgggaggagaggctgcagtgagctgagatcgtgccattgcactccagcctggataacaagagcaaaagtccatcacacacacacacacacacacacacacacacccacaaaaaaaaaaaaaaaaaaaaaaaggccaggcacaatggctcacacctgtaatcccagcactttgggaggccaaggtgggtggatcacctgaggtcaggagttggagaccagcctgaccaacatggagaaaccccatctatactaaaataaaatacaaaattagctgggcatggtggtgcatgcctgtaatcccagctactcgggaggctgaggcagtagaattgcttgaacacgggaggtggaggttgccgtgagccgagatcccgccattgcactccagcttggccaacaaaagcaaaactccatctcaaaaacaaacaaacaaacaaaaaacacctattttgacagccgggcatggtggctcacacctgtaatcccagcactttgggaggccaaggcaggcggatcacctgaagtcaggagttcaagaccagcctggcgaacatggtgaaaccccgtctctactaaacatagaaaaattagtttggcatggtggcatgtgcctgtaagttccagctacttgggaggctgaggcaggagaatcgcttgaacccagaaggcagaggttgcagtgagccgagacggtgccattgcactccagcctgggcagcagagtgagggatctcaaaaaattataataaaaaaataataattctattttgaatagtggtaaaatacacataaaatttactaccttaaccacttctaagtggcagttggaacaggggtcaaggagagcccttgggttgggtaatgtatattcacattgccatgcaaccaatctccggaactttctcatctgacaaaaccaaaactctatatccactaagcaacttcccattttctcccttccccatgtccctggcaacccccgttctaccttctgtttctattagtttgcttactcagtctggacgcttcacataagtgaaggaacaccgtatttgtctttttctaactggcttatttcacttagcataatgtcctcaatgttcatccatgttgtagcatgtgttagaatttccttcctttttaaggctgaagaatattttattgtatgtatataccacattttatcaattcatctgcctatggacaattcggctgcatccatcttttgacgagtgtgaataccactgctataaatatcagtgtacacatatttctatgagaccttgctttcaattattttggctatatacccagaagtgatattgccggatcatttggtaattctatttttaattttttgagaaactgcctgtcctgtgctgagcaggtctatataaacctatctgcaaaggccaaggaacctgagataccaaagaaagaggctgacaaatccagtttctcagaaagaaacatttaataggcgtttatgaacagaaggcaagtcagggatggcaccaagataagatggtggatccctgtgccatcacccccacccccccgacccagggcttctatagcatagggaaagggtaatgcgggcttcagcagggatgtgtatggccagacacggtggctcacgcctgcaatcccagctctttgggaggccaaggtgggcggatcacctgaggtcaggagttccagaccagcctggccaacatggtaacacctcgtctctactaaaaatacaaaaattagccaggcgtggtggcaggcgcctgtaatcccagttactcgggaagctgaggcaggagaatcgcttgaacccaggaggtgaagtttgcagtgagctgagattgtgccactgaagtccaacctgggagacagagtgagactcagtctcaaaaaataaaaaataaaaaataattttgttaaaaagataaaatagaaatcgtagatgaattcttggaactgggattaatcagaacatggcagattagcatccaacatggaattgctttattctcattcaaggtttccctcattcttcactctccccatgctggtcaccttgctgtttgttcctcaaacacatatgacatgcgtttctgtcttggcagtcatcctgctacctgtaatgtcagcactgctttctgttgtcccttcagtcaggtcactgttcaaatagctctctagacaggctcttccttatcattctacttaaaatagcccccaatcactctgtgtccctttagcctgcttcctcttcctgctatttcatactacctgaaaaaatacttgtttgaacttcctagaacataagctcataaaagcaagaactgtgctccacctctcctctcctctaccccagcactcagaagagcaacagagtcagcatccagtgagtgttcatgaatcaagtcactgcttggcagaattcagcactgggaccacagcctcgcctatcttcaactctttctccttctgcttttcctcctcccactctagtagccactcttctgggggcttgtcccttaaatgattagtccttactgacctattttctgtccactttatctgtttttgagagagggtctcactctgttgcctaggctggagtgcagtggcatgaatatgggtcactgcagcctccacctcctgggctcaagtgaacttcctgcctcagcctgccatgccatgtaactggggccacaggcatgtgccaccatgtccagctaatttcttgatttttttttggtagaaatgggtctcactttattgcccagtctggtcttgaagtcctacactcgagcagtcctctcaacttggcctcccaaagtgctgggattacaggcatgagatactgtacctggtcttattttttcttttcttaagatacagggtctcaccatctggcccaggctggactcaaactgctgagctcaagtaattcccccatctcagcctccaaagtagctaggactaaaggcatgaaaacaccatgcttggcttgtcccatttcattctacacactttcttggtatttaaacagctgctgttgctcttcattctgtagctctacatcagattcatgctctagtcctgtatatcaaaatgatgactagaggctgccggctccgctctttcaaaggcacaatgagcgtagcccgtctacaaaactctcccttttccaatccagctttccctcctgcatcacctatctctctacatctggaaccatcggcagctgccttcataaggcacctcggtctggcattcggaaaacaaccctgtcttgccagagcctcctggtcttgggtagcaaaagctgtatgcaatctaaatcaagctttcaatcatgagaaatcacattccttcttttccctttgtaatatactcatgtgtttttttttttccctttctcaatcagcaaattgtaccaccatcttattctgagatgctcctttttaaaagctgtagatcacattaatggaagtgtttactgctgggaatattttccatgtgcaatgatctgtaaccctctttttcttttcttttttttgagaccgagtctcgctctgttgcccaggctggagtgcagtggcacaatctctgctcactgcaagctttgcctcctgagttcatgccattctcctgcctcagcctcccaagtagctgggactacaggtgcccgccaccatgcccagctaatttttttttttttagatggagtctcgtttggtcgcccaggctggagtgcagtggtgcaatctcagctcattgcaagctccgcctcctgggttcacgccattctcctgcctcagcctcccgagtagctgggactacaggtgcccgccaccacacctggctaatttttttttttgtatttttagcagagacggggtttcaccatgttagccaggatgggcttgatctcctgaccttgtgatccccctgcctcagcctcccaaagtgctgggattacaggtgtgagccaccaggcccggccatggccagctaattttttgtattttttagaagagatggggtttcatgatgttagccaggatggtctcaatctcctgacctggtgatcagtccgcctaggcctcccaaagtgctaggattacaggtgtgagccactgcgcccagccaatctgtaaccctcttatctcaactaactgacattattacttcacatccagttcaatttataaattaagagaggtgccatgggccgggcacggtggctcacgcttgtaatcccaacactttgggaggccgaggcaggtggatcacgaggtcaggagttcgagaccatcctggctaacatggtgaaaccacgtctctactaaaaatacaaaaaattagccaggtgtggtggcaggcacctgtagtcccagctacctgagaggctgaggcaggagaatggtgtgaatccgggaggcagagcttgcagtgagcagatatcacgccactgaactccagctggggtgacagagcaaaacatcgtccaaaaaaaataaaaataaaaatgaaaaagaggtgccatgtgtacaaaaatcaatgcatatttatgaactttatttcaaatatattttcacacattttatctaaatacataatacagaagcctgtgtgacttgggcaatgtggccaggagggcctgagactaacaaatccaccttggcaaaaggacataaaatacgtcttatggtcagaaaaatcaacattttgtgtatttacttagtttacgaaaagtactgaaaatgctattattagctgaatttgtgatttccttttgaaattctgagttatccttatttttcccattttgtttttgcaccaaggagactgcagtcaaataaaacagatactacacacacttgtcggggcagccgtactgcagaagcacgttgatgcactcctggctggaggcctgccgggcgtaggtcagcgctgtgttcccgtgggcatctcgggccatgacgtccaccccgtaccagatcaggagctgcgccaggaccacattccccttgcggcaggccagatggagcgccgtgcagccgtctccctccccacaggtctcgttcacctcctcacgggagccatgtgccagcagcaggatggctgtctgcaggtcctcatcagcggtggcccgcagcagctgctggcccagggacagctcagtgcagggtagtggggccagaaagagcttctcctcatatttggaacggatccaccgttccttctcttccctcgtggacttttctgagggttttgtctgcccctggctgctcccttcccagatgctgttggctaggtcattgccaatagatgacataaccttcctgagctcaactggccagtcatccagctccagagatcgcacacgggaaaggcgggtgccaagactgcggtggattcctgagcattcaatacacatgaggactcccaagttcaaactggcccacttaggattctgggtctcacagtccacacagtgggcgttcccacgcatgttttggatcgactgcagggccatggccttgctctggctggtcagctgggacttgcttttactgctctcgcatgactgcaggctggccaggatctggctctggatggcttggacccaggcatcccgctcctcatacgtcgtggcttcaaagtgccacgtttggccagtggcagacacaatcataaagttgttggtgcttttcttctttaggtgtttctttttattggcatgaggagaggggggcgggttgagcttggggctggtggtgctggagatactggggctgaagcatatggagtcacccagcccggtgtccatgtccttggataggccattgcttttagaggtggagatgggtgtgcaggccgatgtggctagggatggccactttcctgggactttgatggtagatgtctgaaggtcaatctcttttttatgaatattcttcatataatcacctaagcttgaataataggtgagcacgccattggaacacagggtgacgtatttctttttccatgtcttcagccatttcccacttcgctttaagagcatgccctgtttaatggggatggctctgccgctcccgatggtgtcagcatgattctccggggctttcctctctttgtctgggtcactccctttctcagatgtaaacaggttggaccagcgcatggaccgcttgcaaacgggggtgggtgtgttggcagtgggaggaacactgaactgagggtcctcctggctggtgctgggagtcgatggaatggaggaggaatagttatttaaactcccacctccatttcttttcttcataatgtgcacggtggaaacctgtgtggaacagaaggaggaatggcttcaaaaattgggtagtggcttgcagggtcctatagacagctcacaattaccttttaaaaagatacattttctgggccaggcatggtggctcacacctgtaatcacagcactttgggaggccaacgtgggtggatcacgaggtcaggagttcaagaccatcctggccaacatggtgaaaccctgtctttacaaaaaaaaaaaaagaaaaaaaaattagctgggcatggtggcacatgcctgtaattccagttactcaagaggctgaggcaggagaattgcttgaacagggacctgggaggcagagcctgcagtgagccaagatcgcgcgattgcactccagcctgggctacagaaagagagtccataaaaaaaaaaaaaaaaaaaaaaaagatacattttctgttgtttggatagtatatttactcatactagctcactaactaaacagagctgcagatcagttcttactccagcacattctttttacaacacttaagatgactaaatgcaacatgaaatggggaagatttaaaaaaagatggctttgacttcagcatgaaacagatacaagtgtacgatgaaaatacaacctcaataaaagtgccacttaccgcaaatgagtgtaactgttcatcaggtatgctcaaagatctatctgcatctctataaaataagaaagcgcattacttcaaaaactgttaatatcttagtataatatttgtttagtaaaatactgcctcctgtgtgctttggtgtttactttaccaaagcagtttttacgaattcttctcttggatcctgacttgcagagggtttcctgacttcttctttctcagcacatcatggcctgtaccgtgaagtcttttatatgataaccagtcagaaatgcccgtgagtattgactctccctaacaggccatggcaataaaccaaacatattttcactcttctaaccacacattgaaacacaagaatgttctacaaagcagttgtagtaaactttaataaatgtaaatgtgattcagatttcctagcttcctttctctttagttctctgtagtatactctcatgatgtatttatgtactttctgttgtttgaatgacaaactcatctgcctttttaagacgccagtctttgatgaactttaaactttgtaaaactaatgcattgtgcctgtgtataaaccagtggttctccaaatgtgctctgtggacctctcgggatcccgaagaccccttccagaaggcctaagaggtcataactgttctttttttttttttttttttttttttttgagaccaagttttactcttgttgcccaggctggagtgcaatggtgtgatctcggctcatggcaaccttcgcctcccaggttcaagtgattctcctaccccagcctcccaagtagcagggattacaggcacctgccaccactcctggctaagttttgtatttttagtagagatgtggtttcaccatgttggccaggctggtcttgaactcctaacctcaggtgatccgcttgcctcggcctcccaaagtgctgggattacaggcctgagccactgtgcctggccaacactgttctgaatcatactaattaaacctgagaaagctgatgaaaaattttaaaaatttgtgaaagtaatacaaagtcattgcctgctttttcattgacacttgccatgattatataaaagcaaaagtgggtacaatggctggtttctcagcataaatcaaggcagtggtaccaattacattagtagtcattctattcttcactgtcccctacaggtaaaaaacatagcctgaatttcttaagaatgtctttgatgaagcagtaaaaattaatgttgttaaatcttgacatgtctctaatattctgaataagtggaaagttaaccagaagcgctttttttttttttgtttttaaagaatccgtgatttaactgtgaactgaaaaatcacttttttcacagaacatcatttttatttaaaagtacaactgggccagcgcagtggctcacgcctgtaaaatcccagcactttgagaggccaaagcaggcagatggcttgagctccttcaggagttcgagaccagcctaggcaacataacgaaaccctgtcactgtcaaacatataagaaaattagcctggcgtggtgccacacatctgtggtcccagctacaaaggagcctgaggtgagaggattgcttgagctgagatcatgccaatgcactccagccaagtgacagagtgaaactcggtctaaaaaaccagttcaactatcattctcaaaaataaatgaagtgagaggttgtcacttcaagggaaatacgtatttgttcccaatgataaaatttaagctttcctgtggactttgaaaaacttgttccttctactgtaggcttggcagcttttcaatacttaaaggcgtgttaaagaaagattggtggttaaactaaaagtgatttttgacacaataaaacataaaccaatatattccaagtaactaatgcatgatattataaatgcaagtatggagcaaaagatccatttactgtgcaagaaagatcaatgagtactgatggaataaatttattaatatgtaaaatgccaccgtaactaatttaagaaaccaccacttgtgaagttttgatttagtgttaacaaatacccacaactgtctgaaaactttaaaaatacaccttctaccaactacatatttgcatgaggttaggtcatcttattgcttctttttttctttttttgagacagagtcgctctctgtcacccaggctggggtgcaatggcgagatctcggctcactgcaacctccacctcccaggctcaagcgattctcctgcctcagcctcccaagtaactgggactacaggcatgcaccaccacgcccagccattttttgtactttcagtagaggcgggttttaccatgttggtcgggctggtctcaaactcctgacctcaagtgatccacccacctcggcctcccaaaatgctgggattacaggtgtgaaccactgcgccccaccagcttattgctttttttgtttgtttgtttgtttaggcagagtcttgctctgtcacccaggctgcagtgcaatggcaccatctcagctctctgcaacctccgcctcccaagttcaagcggttctcctgcctcagcctccagaataggtgggactacaggtgcgtgccatcatgcccagccaagtttttgtatttttagtagagacggggcttcgctgtgttagccaggatggtctcgatctcctgaccttgtgatccgcccgcctcagcctcccaaagtgctgggattacaggcgtgagccaccgtgcccaacctcttattgctgctttaaagcaaattgcaaagaaagctctagagaatccatttgtctcctattaagctcaacatgagagactttaaataatataaatacatgacgcactttttactcaactttttgttgtagaaaagttatttttcaatgaaaaaattctgttaacaatactgttctcaaggaatattttctgttgttataacctgggtcatgggttactactgatatctagttggtagaggccatgaatactgctaaactctctgcaatgcacaagacagtcctcacaacaaagcattatctagcccataatatcaacagtggtaaggctgtgaaatcgaaactaaaaatagattttgaaaaaatttcaattgtataattctaccacactaaatatcaatataatcaatataaacacatactctttgagattctcaatcatttaagaattatgagagtcttaaggaacaaagaaaatacaaataatttgcttcaatattttagtaggcacaatacagcttatgatgtctagagctgtgacctaacactgagcttgatatcttgcaaagtacttagctagaataacaagacaggtttctaaaaagctcacctttgtgtgatatgatgaggtatctccaaggtcacactgtggaaggaaaaaaattcataacaatagatgttaacatttgttaggcctgaagacattttttaaaaggggggcagaggaaactctcctagtggccctgaaattcaaatcttctagttcagaacagtaccataagggcactttgttttcatttctttgttttttacaaaaatatgagaaccaaaatgcaaggaaatatgccgttagaagacgcgtttctgttggtgattacaatatataaataataacagatttccttgttatatgcttttctacccacgaaacctttcgtcccatgcgatttattttatgtatttatttattttttgacccagagtctgtctctcttgctcagactggattgcagtggtgccatcttgactcctcacaacctccaccacccaggttcaagcgattctcatgcctcagcctcccaagaagctgggactacaagtttgtgccactatgcccagataatgtttttttggggggtggggtggatggagtttcgctcttgttgcccaggctggagtgcaatggtgtgatctcggctcaccacaacctctgcctcccaggttcaagagattctcctgcctcagcctcccaagtggctgggattacaggcatgtgccaccacacccagctaattttgtagagtgaggctcaaaacaactgagggaaggcaaatctcaattctactaataggtctacacaatattagcactttttaaaaagcctgtaacattagcaggtaagatggatatgtctatagtgcttcaagtagttttcatctctgaaataattttaaaatcacagaatttaaagttacatgctggaaaggaccaatgaccttatgtgacatttaattcaacactcgttttacagatcagggaaacagaccttaaaactgacttgcccaaggtcccaccaaattggagcagtttctcgtcctaaactcaaattaagcagtggctgtcaaactttgctgcacattaaaatcgcctgagaagctttaatatctgcctcatcttccacatgagacattttaatttaattagtattgggtatggctttgggcatcaaggttcttggtaaacatttcccaggtgatttcaatcagcagcaaagtttggaatgattgagttggggtgaaaatcagaatcttctgggatgcttttcttcacagaaagatgcctcacatccatcccgattttcctaaaaggcttctcagtgcctagagatagagggaaagtggagatgggaagatacatgtgtttgcagacttgtattttgaaaaaaaccttgcataagtgatctcagcgagttccacctatcccactgacaacagtgcactactgattcatgataaaacatttttcaaaatatcttcttgaagccaatttgccctattaatttgttcaataactttatttcaccaatagtgaatacaccaaatgatcatttctcaaacttgctggtggcaaattaaaacttactatactctcaaaagtagacttctaaaaagtagaataatgaggaaaaaagcacgaaatttgtttcagcaaaattaatcttcaaagctgcttttgaattatatgctaacatatcaaaatctttggaactcagaagaagccagggactctagtcaaagtaatttttgtgtatgtgtgctcagagatttaagagacttagctgactacagacatttagtgattactcaataggtcccaaagctcaggacttgagacagagtttgagtccagtttttgttcgaaacacaatttcctctcaactattgttaaaagggagggaggaaagtgacattattatgagtgtaaactttccacttttaattgaagtaaaagttattgacaattgaattagttaaaaaggctagtgcatttgaaacaaaattgtttataagctagttatgtgtacagaatgaaaagttaaattaaagataaagacattaatattctaaattagcactttccaaactgtgttctaaaaatcaagactaataacccaagaagatgagaataatgtacactggacagcccctgtggagctggtggtggtgttggttgttgttccttttaaaataaacttcatctcagggtgctctcaaagcgcatctttgtggcccacgaggtgctcatgcacaatgggagaaattcaaatgcagatacactgtggtgccagaagaagaaaagctgttccttcttccaaggataatgtccaaagtagtgcacactgatttaggcctatgatgcattgaaaaactaagtttccacaaaaaacattcaataaagggaacctatccttctcactgtgttcaacattgtctaaaggcataaaggcatcaaaaagatacactgtttctgggattgcttctttgctaactgatttttccttccaccacgacgtctaagattaaaagagaaactgatacttaatattcagaatctggatatcaatatatggttgactccaatttcttaaactgattgctgaaaaggacaaccaaatgactgaaataattttagaataaaggaatctgtccctcggcagcatagttgtactcacgatattattgtcattgtaagataatgctggatggctgtgctgtcatcaaggaatattgtcgaacacaagctgtattgttgactgaaacgcacagtagatacctgaaggggaagggaagtgtaagtcaaacttatcaaagtgtattattttctcagttaaaatgtcaaatgacaaagcactaagatatgtcttacactccatgaaatgcctgagtgtggtatcatgtgcactctatagaaaacccattggaggctctcaacttccagagatgatgtttaagatatgggttataaaatgctgcccttaatatggtacctgtcatcaaacctaacaaggattttatgaattaccgttaaaaataatgggaaaagtcggcttcgcggggcacggtggctcacacctgtaatcctagcactttgggaggtggaggcgggcggatcacgaggtcaagagatcgagaccatcctggctaacatggtgaaaccccgtctctactaaaaatacaaaaaattagccgggcgtggtagcaggcccctgtagtcccagctacttgagaggctgaaacaggagaatggggtgaacccaggaggcggagcttgcagtgagccgagttcgcgccactgcactccaggccggcagacaaagtgagactccgcctcaaaaaaaaaaaaaaaaaaaaaaaagaaaagtttaaaataagatttcatttttttttctgcagcaataaaaagcagctgagaatttctattaattaattaatttatttatttatttttgagacggagtctcgctctgtcgcccagactggagtgcagtggcgcgatctcggctcactgcaagctccgcctcccgggttcacgccattctcctgactcagcctcctgagtagctgggactacaggcgcccaccaccgtgcccggctaactttttgtgtttttagtagagacggggtttcaccgtgttagccaggatggtctcgatctcctcacctcgcgatctgcctgcctcagcctcccaaagtactgggattacaggcgtgagccacggcgcccagcccttctattatttatttactacgataaaatgtaatgtattaaataatcctgctacaagagcattttattgcagtgaatacaagactaatgcatttactaaattactaatcctaaatgtattatttcaggtgatattgttacaaaagaagtgtttcagattcagaggctctgtgtgtcagggctgctaggccaccaacaagtgaggaagccataggtttctctagtcctattttcttatgtggaggataaaaagagtatcacttacatattctctcacaccctgaaaacaaatgacaacttaaaaaatctaactttcacttcatgtttaaataagactgccaagacatgactcaaatgagactctcggagaatactttgcattcacttcaaaacttgatcaattgcattctataaatcatctgacctgcacctagccattttcctgctctacccctgctctctgcctagaatactgcttttctctttccttgcttcagcaagctcgactccatctaccctcttggatctctttgtcggcagccacaccaaaaaatgtatttttatacactaattagttgaattcaccactgcttacaagatgctaattcctgcagagtattccccttgtgagaaagtatgcctctccataagagtaagggagggcccttactcttcctacctccagctgctgagcatagaattttgagtaaatccaaaacttcgacaagtgtttgacaattcagttatcatttggaaggtaagtcttactacatttaattacagcaaaaacactactaacagtttactctttataggtattatttaaggtagtcacaaaatagaaacaaacactctaacgtcaggcagcataaatgagagtatgaaattttacaatatttaacaagaaatggaaggggttacttagtagttttaaggtttaatgacaaaaactagaaaataatcgtacctagtaatttagtaagtcaaaaccaaagccttaccatcaaaggtgcagtacccattggatgcggatgcccacgcactgacttcttctgctgtacctgctgcctctcattttaacccattaaaaatactaaagttgttttccttgtagacatctttcacctccttggttaggtctattcccaagtattttattttagtttagtttagttttgcagctatcagaaaaggggttgagttcttggtttgattctaagcttggtcgcttctggggtataacagagctactgatttgtgtacattaattttgtctcctgaaactttgctgaattcatttatcagttctaggagctttttggaggagtctttagggtttcctaggtatatgatcatatcatcatcaaacagcaacagtttgacttcctctttactgatctgcatgccttttattgttttctcttgtgtgattgctctggctaggccttccagtagtatgttgaatacaagtggtgagagtgggcatccttgtcttgttccagttctcggggggaatgctttcaacttttccccctttcagtatcatgttggttgtgggtttgtcatagatggcttttattatattgagctgtgacccttgtatgctgattttgctgagggttttaatcataaaaggatgctgcattttgtcaaatgctttttctgcatctgtttagatgatcatgtgattttttgtttttaattctgtttatgtggtgtatcacatttattgacttgtgtatgttaatccatccctgcatccctggtatgaaacccatttgatcatggtggattatcttttttttttttttgagatggagtctcgctctgttgcccaggctggaatatgcagtgtggtgatcttggctcactgcaacctctgcctccgaggttcaagcgattctcctgcctcagccacctgagtagatgggattacaggtgagcgccaccacacccggctaacttttgtatttttagtagagatgggatttcaccatgttggccaggctggtctcgaactcctgacctcatgatccgtccgcctcagcctcccaaagtgctgggattacaggtgtgagccaccgtgcctggcccgattattttttgatatgccgttgggaactacaaaacgttgctgaatgaagtcatggacacaaacaaatggaaagacaccccatgctcatgaatgggtagaatgaatattgtgaaaatgaccatactgccaaaagcaatctacaaattcaatgcaactcccatcaaaataccaccatccttcttcacagaactagaaaaaacaatcctgaaatttatatggaccaaacaagaaccggcacagccaaaacaaaactaagcaaaaacaacaaatctggaggcatgacattacctgatttcaaactatactataaggccatagtcgccaaaatagcatggtactgatataaaaataggcacatacaccaatggaacagaatagagaacccagaaataaactcaaatacctatagccaactgattttcaacaaagccacctaaaacataaagtgaagaaggtaaaccctattcaacaaatggtgctgggataattggcaagccacatgcgggagaatgaaactggatcctcaactctcagcttacacaaaaatcaactcaagatggatcaaggacataaatctatgacctgaaaccataaaagttctagaagataacattggaaaaacccgtctagacgctggcttaggcaaagacttcatgaccaagaacacaaaagcaaatgcaacagaaacaaataggtgagacttaactaaagagcttctgcacaggaaaaggaacaatcagcagagtatacagacaaccacagagtgggaggaaatcttcacagtctatacatctgacaaagggctattatccagaatctatgaggaactcaaacaaattacaattacaaaaatatggaaccagctcaaatgcccgtcaatcaatgagtggataaagaaaccgtgatatacatacatatatatatatatatgaggaataccacctcagccataataaggaataaattcatggcattcccagcaacctggatggaagtaagactattattctaagtgaaataactcagcatggaaaaccaaatatcatgttctctttcatacgtgggagctgagctatgaggatgcaaagccataagaatgatacaatggactttggggacttgggggaaaggctgggaggagggtgagggataaaagactacaaattgggttcagcggatactgctcaggtgacgggtgcacctaaatctcacaaatcatcactaaagaacttagtcatgtcaccaaatgccacctgttcccccagaaacctatggaaataataaataaataaataaagtacagcatttttctcagcaaacataaaataaaacaaagactaaagttcatatttttcactctccttttgggcaggacaaattttagataggtttttaaagaattagtaacttttttcctttttccgagacagggtctccctttgttgcccaggctggagtgcagtggtgcaattatagttaactgcagcctcaaactcctgagctcaagcgatcctctgcctcagcctcctgagtaggtaatacgaaaggcgcatgccaccaggcctggctaatttgttatttaacctttttgtagatatgaggacttgcgatgttgaccaggctaaaaatgaacaaatcttaattaacttaaatatttctaacactttgggcattcaggaaaacagctccatctatgttgtgaagtaatgggaagtatatggcagtggataaactttgaatgaaaatattaaacaaggccttaggagaaaagtgtaatatgcttattatagatacattaatttaaaaaattctctggcttaatatcattaattatactcaaattagactttgatttaaacacaggtcctaaatttggattaaatataatagattgaccacaaatttatttcgtctccctccggaagcctcatcagtcataaaataaaggttacacccatgaccagcacagaaggttgacagagataatttttaataaatgctgagacataaaaagtagataaaggagtggtaaataacacagaaacacaactttggtgcctacagaaagtgactggaacagaagcgagccagtttgtcttgcagaactaaaggcaggttgtgaacttacaggcaaatggcactttggaaagtagggtaaaatgtgaaaaaaaaaaaaaagccagcaaggtcagttgcaaatctctaactagagccccaagtccacctgtccttccatctgacaagaaacttagatgtgtgttctctggatatatcaaacctgagaatttctggctcagagataccatggcttaaacctgagatataaagaaaactgtacaccaaaaatggaactccaactttcttcgctaactctgcttttcctttccaggcctgcttttactttccaggcagaaaactgggagatccttctcagaagaaactgaaatgtcttcaaaaaagatccccagataatacactgaggtctcccaaatgaaaagctagtcaggcttctaaggcctcacactgagtgctatcagttaacagaaatcctgcttccaaataaagcaggccaggaaccaccacacattggagggaagcctccaagaaaagagatcaaaacaatagaaaaaaggaattgataggaccagtcaaaatcaggagcaaaactttaaaaaaaaatcttaaaacactctcaaaaaatataaaattcaatagaaatagtagaggataaagtcacagaatatcccagaactagaataaaaagacaaactgaaaaaaatacaaggggaaaaattaaaaatcaatgcaggcgtactggtctaagcagcctagcatctgaataacaagactatcagtaaaaaagtaacagagaaaataaaaaaaaaaattctcaagaagagatagtctgcaggtttagtagcctcaataaaatgaaaagatccccaacaagctgttataaaatttcagaaccttagagagagagattctaaaaagcttccgcagataactaaaacctggttgtaaataacatatcacacactggcaatagattcaagaacaacactgtaataagagcacaactgcaaaatgtcttcagaaccatacaatttagattcaacctagaggtgtactctctatcaaagaggagggattttaacatctccacacaggaaaatgtgttcaagtacaactagagacgataacaggacagaaggaaacacagaatctaggactcaggcgatcccacacaagacagcagttacatgagataccaaaagactttaaagagttagcccagaaaagcagacattgagcatatctagggaaacccacgctatattgaactaggatgacaaaaggccaaagaaagttgccccccacacaaacataaaaaggaacagatgtgttttcgcagatggaaaatatctttgaaaggcatgtgataaatgctacaatacttgggggaaaacagctgttagaaaacaggcaaatgaatatagtcagaaaattagcttcatgctaaaaaataatggatgtgaaagcaaacagagcacccagaggctacttaacgatatttggatagataaactaacgtaggctaggaaaaaagaagatccaggagaattgcagaagtgctcagatttcagaactgtttcagagacaggatgaaggacatggaatgcagaggcacagtgaaaacaccatatgacttagcagtgaataatatttgcagagtcataatcatgtaaatattactgatttaattaaaaagtgtgctacaattggaagaaacacagggagaaacataagatcatggtgtagcggggaaggtatgcttttacctgctgtgacagaaagtcaatagacagtgctggcaattaacttagctattctatttttgttctttcattaaaaataagattaaatatttaaggcaattttttttttttttttgagacagagttttgctctgtcgtccaggctggagtgcaatggcgcgatcttggctcactgcaacctccgcctcctgggttcaagtgattctcctgcctcagcctcctgagtagctgagattacaggcatgcaccaccacgcccagctacttttgtatttttagtagatacagaatttcaccatgttggtcagggttgtctcaaattcctgacctcagatgatcagcctgcctcggcctcctaaagtgttgtgattacagacgttagccaccatgcccagccttaaggcagatcttttgaaccggactattgaaatttaacttaaatgtcagaaatctttaaaaggtggacacgctaaactaagcacttttctggataaatttaatactcaggaaaatagaagagatttagaaaatccacaaaaagaggtccatgctaccaccaccaggtccacattgtaatttaaagaaatcaagagagacatccttttatgtcaaactatcaatttcttaactatttgagtgtttacttacatggtttgtacagttgcttcttcttatttctacaactaagaataaaaaaaaaaaaactggtcacttctgatacaaataccataaaataaaagtagttgttaacatcttactgattactcctatgaaaaatgagacaaaattccattaaaaaaaaaattttcaataacatataatttaaattatctggcatgattaatttcataagtcaaatctaaaaacttagattttcatttagtttactttttgtttctattacacacaaatgaaagaatcctcatgtacaaaagaaaagggcaaaaaaattaggccagatgaaaaatttagctaataaaaagtttaactgttgcatatatgagccatgatccattagtattctctcattctgcatttacacatagcttactttaattatcagactctaagagctaacagttctaaaaactacttcctgaccagacacctatctctagatgcaacagaatccctgtaagcatcttgaaccacacttagtggttatctactaatatgtcactaaaaacaaaacaaaattaaaaaatggtctttacacaactggaaagtaacctatcttaaatttgttttcttttttgagatggagtctcactctgtcacctaggctcgagtgcagtggcgggatctcagcgcactgcaacctctgcctcccaggttcaagcaattcttcagccttagcctccggactagctgggaccacaggcacgtgccaccatgcctagctaattgttttttgtatttttagtagagacagagttacactgtgttagccaggatggtcttgatctcctaacctcgtgatccacccacctcaacctcccaaagagttgggattacaggtgtaagccacagagcctggcctaaattttgatgttaaaataagtatacaaacctaattggacatggtgtctgcagcacaaaaaatcattttttttccctaaaaagaggccagaataataaaagccccaagagggacttgggccatgctttgtttcctacactgcctctgcctttgatgctgggagggccttgtaggcaaaagttactaccactgaagagtgagggacatggaatagcttttcttttactgcttccatgctctctaggtgtgagaagcccatgcctctggaaggaactgggaaatacaattctgatatgttttggatatgttgcccctccaagtctcatgttaacatgtgacccttaatgttggagacagggcctagtgggaggcgtttgggtaatggcagtggattccttatgaatggcttggtcccatccccatggtaataagcacattctcattatggtaatttaaaagactgtggtactggccaggtgcggtggctgaagcctgtaatcccagcactttgggaggctgaagcgggtagatcacttgaggtcaggagtttcagaccagtctggctaacatggtgaaaccctgtctctaccaaaaatacagaaattagccaggtgttatggtgcccacctatagtcccaactactcgggaggctgaggcaggagaattgcttgaacctgggagatggaggttgtagtgagccaagatcgtgccattgcactccagcctgggcaacagagtgagactccatttcaaaaaaaaaaaaaaagagtgtggtaccttcccccttcccctctctcctccctctttcacggtgtggaaccacctgcttcccctttgccttttatcatgattgtaagtttgctgaggccctcaccagaagcagatgttaaagccatgtttgtacagcctgaaaatctttgagccaattaaacctctttttgttataaattacccagccttaggtatctctttatagtaatgtaaaaaatgaagacaaattctaaccagaaataactgactcaagatgggcaaagtctactcaaactataaaaacaaaggttacaaactcccgtgttttactgtgctgcattacttcgcacattataatagaaccctcacttgtgttcttgctgtttaagtcaactggaaaacttggctgtgtatggcttgttggcaaataaatgaggatttaatataacattaagggaaataagcaggagtaaggcatgtttaaatttacattatatcaaatgaaaaagttaataacctaaaacttttgagtagcgtaaacttggatgtggtaaatgaatgtggtcagaggactgtgtaagaggaggcccaaatcacagattcaatccctgatgataaacgactatgttttttaatttgtttaaatgaaaaccaagctgaagttctatcattcatctttaaaatgtactttttggagcaagggaaaagggattgtaaataaagatgaatccattaattataaataaagataaatccaagaattataaagagaaatccatgactcctccatcacatcacaaattaattgtgttgataaaaagatggcaaaatgtataaacaaaaaggttacacgttttcactaacatcataacaactaaaggaaagtatatcacatattaaaataagacaagggaacatgtgaaaagatgaaaattttaaaccaatatgagtttttctaaatactttctataacctgatcaaacaagagcttttattctttctcttggtggaaaaaacaatgtcgtctcaccatctgtttgagagttcctctggaatattgtgcttgcctctggattggcagaagggttaaactccaaagctatatgcatagaggaagaaaagaaaaaaagatgtaatcattgataaaaatttatcaactcgtttattcgactgctgcatttaggctatttcactatctctactttgattcttatccattgaaatgaatgtatagacataagagagagccaggcaagatggcacatgcttgtagtcccagctactcaggaggctgagatgggaaaatcacttgaacccaggtcaggaagttgaggccagcatgagtaacataatgacaccctcctttatttaaaaaaaaaaaaaaaaagaagaggtaaattttggctttgagttgtgtaaaatcaactttgcataaaataaatcaagatggcagtaagttttaaaagacaggtctattttataggcaaaatataagatgtattctagagtttttaaaatttttaaaaagtaaattcatcatatctgtcacttccatttcattctgaggacacagaaccttagttctcttgagtagctgtcttccatagtcatgtgatatctctaagttttcatttcttcgttagcaacacatagggagaacatacacaggccttatttgtattggaaagggccaagtgagacatacataaactgtgttgtaatcctaaagaatgacaataaagagccatttttgggctctcatccaacactacccatctactaactggtgtgtaacatccatcaggctttccgaacatcaccaagcagagtataagtttacacaagtacttacatgctttgtgtataaaggtacaatcaattaattcacataatacatttgtttattctaaagcaatccttaaatatcttgaaatgtgaagatagtacttccaagttacaaagtcacactcataatgagtcttaattatcctacctctttaaaaattaagagcgcaaccaaagtttaaatagaagagctataagacatttcctctacagtgatgaaatctctggcatttaaatgaaaacaataagcctactggatgtaatatgtttatgatgcaatgttttctattttgaaaatttcagtttttattcaagaaccatattattacccagaattacttttacttagattcatctctttgcaaaattttagaggcaaacgaactaattgttttctcttttctaccggctcccatcccctgcctctgccagcagtgtagagactaaaaaactccaactttctttcctttttttttttgtgagacggagtctcgctctgtcacccaggctggagtgcattggcgtgatctctgctcactgcaacctccacctcccaggtccaagcaattctcctgcctcagccttgtgagtagctggaactacagtcatgtgccactacgcccagctaatttttgtattttttttttagtagagacagcgtttcaccatgttggccaggctggtctggaactcctgacctcaggtgatccgcctgccacggcctcccaaagtgctgggattacaggcgtgagccaccaagcccagccaaaactgtaactttcttatctttgaacaagatgctattgtcaggaggggaagggacaaagggggagccatggcaacaaacactcttacagggaaggtctgacattttaacctgcaatctttatattacacattgaaagtctacattgacgtttcatgtcttttgaaagttttgaccatgaaccaatccccacctctcttttagaacaaggaggtaaataaagtctgttaagtcaccagaataaatctggagacacattttctgttaaagtaagaactttaacagaaaagagcttcataggtaaactcctttgagaaaccccaaacacacacacacaaccatttttctgcagccccggctgtgacatttcacacctttcacaattattttaagcactctccttttttctttttccttctgtgttcaaattacagttagaagaaactaagcagcttctatcaaggtgacttaaagcagcccattaagaataccatatagcctctcccatggcaaactccattctgattttaaataagaaatccccaaatatttgaataggaactgtcttgagatttggctactttaacaaaggaaacaattaggcacttacctggttccttcacttaggtaccatctggataggtacaaagaaaaaataagatgggtactgaaaagttgggatatttgagtttttattgagaaaaggaagagaatagctcaaagaagcctaaacaaagtcccacaggataataaacagagctacagacactgttgtctcaccatctgtttgagagttcctctggaatattgtgcttgcctctggattggcagaaaggttaaactccaaagctatatgtatagagggagaaaagaaaaaagatgtaatcatttataaaaatttatcaactcatttattcaactgctgcttattcgacaagagccataaataaatggtcccatgccagcctgggagaatgagatgagagagcaagaactgggcgattgggaggggaggcgaaaagaaactgactggactcggtggggaaatactaaggggtgggaattcaaggcagagccagcttttgttcctggccagctcccgggaaagctggctacaagcagaaaggagctcgaagtgggggatgcctcaaagggaaccttggggacagtagcagccagaggcaaaccgagggtagatggcacctatcacctcctcaccttcaggcatctcccggtcacgaacgtggtgcatgtggaggtcctcaccaacttcaacagtcacctcagcaggctgtacagcagcagccatgggcgctcctgccatcctgtccccagctcctgcctcatagatctcagattcagagggacacaccgacccctgctgctggtcaaactcgaggctgacgctagggtgcacacgacaggtcagtatgttccccatggggcgcctctactgtctgccaccacctgtgcctctgctcacagctttggccacgcactcccgctgtcctaggccgaggctatgctgcacttgcagagatggtcttcccgctcctcgcctgcccacctcacagcgcggccccgggcaccagccctggccctggccctggccccggccccggctagggctgcgggccaaggcccgcaccctgctgcctcccctgagttgacttgtctgggagggtgaagaccagccggcttatttaataggttgtgaacccaacaagtgctgagagacacaacaactgcctgaagagagaacagacggagctcctcctccttctgtagtcacctacagactgaagcccactggccccaggtgggagcccaggcatgtggcacacaatgccccaccccacacttcacaatgccctccccgacacctcacagtgccccaccctgcctgccacccctccccaacagctcagaatgcccctgccttggctgccccaccctgtggcttatgatgctgctgctctcctggcccctcgtgcagtgccattgggactaaggttttcattcatcaccagcttcctgagattttagtcctaagaaaagcaaagggtagttcattacttgaagccatcttcctctatgagttctatacaaagcctcagtagagtgggtccaattagcaaccaagttgaacaacttttatttgctgactaaatatagatacacctgaattgttgactgcttttgtaactaaacactcctctcctgtcttccaacgagtggtcatttttgtccgcaacttgaccacagcaatccctggggccctagctctactctcaataaagagttatggctgtgtgttttgaatgacaccttaggacccatcctgcctccacctccttctccataaaatagaaacctaacttgcccctccaagctctgaaatgctgaaacttaccaactcccttttctccccgctatttcttccttccgtggcagggactttcaggttttctttcttttactaacaaggcactaagcatgattttctcatacaaaatcgagagccataaagtggcttaccacagtcctatttcaataaagatgaatactcgacatctggcaagtagtgtgtgcctgacagtgtccccactgtgctatgctcatttaaccctcagaaacaatctcatgttacagattttgcagaagttgttgagacggagaaggtaagcaacctccccaaggtcacatgactgctaagggtggggccatagtttgatcccagctagtctgaattccccagttgcttaagcatgattatcagaaagtatagcagtctgttttcacactgatataaagaaatacctcaggttgggtaatttttaaaggaaagaggtttaactgactcagtttcacatggctggggaggcctcaggaaacttagaatcatggcagagggggaagtccttcaggaaacttacaatcatggcagaagggcaggtccgacttccatggtggccgcacagagagtgggaacatgtgaaggagcaactgtcaaacatgtataaaaccatcagatctcagctgggcacggtggctcacacttgtaaccctagtactttgggaggccaaggcaggtggatcaactgaggtcaggagtttgagaccagcctagctaatgtagtgaaatcctgtctctactaaaaatacaaaaattagctgggtgtggttgtgcatgcctgtaatcccagctactcaggaggctgaggcaggagaatcactggaactcaagaggcagagactgcagtgagccaagatcgtgccatggcactcctgcctggacaacagagcaagactccatcccaaaaaacaaaacaaaacaaaaccctataagatctcatgaggacttactgaatatcacaagaacagcatgaggataactgcccccgtgatccaatcacctccccctaggcccctccctcgacacatcaggattatggggattataattcatgatgagatttgggtgggggcatggcaaaaccatatcagaaagtaaaggtagaagtcaagcttggatgggaaatgacattgtagatgatgatgatgatgattattattattattattattattattttgagatgaagttttgctcttgttgcccagtgaaattgtttctctaatttcattttcagattgtgtcttgtagatgtatagaaatacaattgataaatgattctggctattaaccttttatgcttcaaccttgctgaacactattttttttttttttgagacggagtttctctcttgttgcccaggcaggagtgcaatggcatgatcttggctcactgcaacctccgcctcctgggctcaagcgattctcctgcctcagcctcccaagtagttgggattgcaggcatgcgccaccatgcccagctaattttgtatttttagtagagacggggtttctgcacgttggtcaggcccgcctcagcctcccaaagtgctaggactacaggcatgagccaccgtgcccagccagattcgtatatttttaaaagaattttttttttattttttttgagacagagtctcactctgttgcccaggcagtggcacaatcgttgctcactgcaacctccacctcctgggtccaggtgattctcattcaagtgcctaagcctcccaagtagctgggattacaggagcccaaccccatgctcagctaatgtttgtattttagtagagatggggtttcaccatgttgctcaggttgatctcgaactcctgacctcaggtgatccacctgccttggcctcccaaagtgctgggattgcaggcgtgagccaccactcccgaacagaacaacatttttttgatgtggattttaaaatgcctccccttctttcaacattgattaagtcccttctacatgccaggcactgtatgtgtgaaatagtcccaactctcaatgagtgtaggcagatacacaaacaaagccttaaggaggtcagttttctgagaccatactgctggacagtatatgaacctgggatacaaacccacctctatttgacctcaaatttgatgctggggtggttttaattttattctgggaatttcagtcattgaaccatgaaaaggtgaaaagtctctgtcagatgtgtgtgtagtggtctgtataataaggactgaaggaagcaaccaaacaaattaagagactttctctaaaggcagagtaatgctaagggcagtggcagtgacaaaagcggaggaaaaagtctgtgatcatttgggagacagaataggaagtgcttggtcatgagatgtgaaagaagaggggaagtagaaggaaaacagagctgctcaggctctgctggggaagactgggtatgtagcagtgccttcctcctggccaagaatgtaggaagagaaataggtaaggaggaaaagacagttttttactctcagtgtcacattaaaatggaactctctggtcaaaagttgaatataaatctctgtaggctaagtccatttgtgacatcccaacatatgttttcaaaaataacatacatactaaatcaagccattaagcgtaactggggaaatttcctaaaatttacatgctaaaaaatcaccatttttcatttattagtttcatggagcaactttgaatctatggttacagcaattgaggcaccttgtataaaataaagctaatacatgaaaaaaaaaagccatttaaaattctgttgttctcagagaatggagaaagcaattgaagccatgggtgtggaggtgactgccctgagaagctgtgtatagtaaggagaactgggaagaaagaagacctggagaatagggtgatttgcacggcattaagtgaagcttgcaaaagtgagcactgagactcaagagacctgcatatgaatcaggaatggctgctcctgtgagttgttagaaaggagatgatgccttcttttcatatctataacagcagcacctagcacagtgcctgttcaataggtactcaacatgtattatcccaatgcagagtcaaattttgccaggagggcaggaaagccacaaattagctatggcaacttagtgattgggcttgtgtgtgtgtgtgtgagcgagctggatgtcaggcagtgggtaaagtagtgaactggaggtgagaaaacaatgacacaaactcagggcttctcttcccaagtatttggctgagaagagagatgtagtattaaagggagatatgtggtaaaggaagacttttattccaagattcaacaaaagcgtgagtatacttctatgttaaagggaaagagccaacagagaaaacacatttttgaggttagaagagaaggaagaactaatgcagaagggccccaaaaggcacaggtgcctgcaatctggatcagggacagattagctttggactcctacaaaagcaagaagggagaaaggaccatgtgactctagagatatttctggtaaaggaaaggtttaggaaaagatcttttgatgacctttattttaacagactttttttttctttttgagatggagtcttgctctgtcacccaggctggagtgcagtggcacgatctcggctcactgcaacctctgcctcctgggttcatgccattctcctgcctcagcctcctgattagctgggactacaggcacccgttaccatgtccagctaattttttgtatttttagtagagacggggtttcaacgtgttaggcaggatggtctccgtctcttgacttcgtgatctgcccgcctcggcctcccacagtctgggattacaggcgtgagccactgcacccggccagactttaaaaaaaaaaaaaaaaaaaaaaaaaactactgtgggaaaaaggatattatgtatagaaaagtctacacttcttgatacaactaactaaaaaaagcctgatacactaaacaaaacccaaataatgtcttccctaaaagtgggtaacttgaaaagcaatttgagcaaaaatcaaggagttcaattataaataagtatatcaacaaagtgaaagatgggtttaatttttcccacaaaaagttaaaagaaataacagcaggtttagaggaagaggaaaaaataataagaaaattatatgcagttgcaaaatgtgtgactatttacaaactctaacatataactacaaaatggaccagaagaatcattatcataggaagcaaagggtcatttcaaaaatcagaggagggatgattcatatttaatttaattctgtggaaaaaatttaagtaatgtttgaggacaaaaataggtgatgtgttgaaatgcgggaaaccacagtggaaggaaaaataattcaagaaagctcagtttcagtaaccagtatctagtaaaatcttcaggacctagaggctacaatctgcattaatagtgtctgaagacctagaaatgtcattaaataccattttggataattcttgtagacttgagatgatgtctatttaaagttacaaaatagtgcccatatttctgtattcattacagaaaacaattggatatggaaaagaaactaacatgctatgccacaatctctaaagaaagattagggaagtttcagcttaaagcaagaataatcacaataaagttttacaaccctttgcaagcatatatgaaaaacttacaaaaagtctgtaatgatcttttcttaagctaagagaacagaaaaaatgagaaaaattaaattataaaatgaaactttggtttagaggtaagaaacatttgatgacagtcaagagatcagggttgtacagtgtattatgtgaatgttgtgactcattggtttcatcttggatatcataacttgacattttgtaaaagtgatttttcatgggagtttcttcaggtgccctatgaagtcctgtccctttagaagcgaataatagtcttccacattcttgagatatcttaatgaataacatcttctacagtcttccattgtttagaccttggagagacacgcattagtgactgttaaggtacctgggttattaggtgcctgtagactatgcccagtgatatgtgcattaggtacatgctccctagctgtgctgacactgactgaagctgtgaggtttcacaatgacatgtcagccaaatacatatgctcagatttaccatttatcaagaggtcttcacactatcaattgtgcaattatcattctacacacaggcagcgataaagggagtaaaaaaacacagccatggatcgggagaccaaggtacctccagaggagtccagtgggtccagaagccctttggatgttggtcagaagctcctcttgggcagagatcacagcagcagccaacaggtctggagaagaccttacagttctcatggacaaagtttgtgaaggcatcttagacaagatcttgtctttgctggttttatgatcctctgcagatgggtctattctcattacctcagccacctttcacttcctatcagttcagttcaggtctctcatgatcccaggcagcagtagttgttatcacgtaagttcattcatatatgtttatctctggggatggggggacaacttcactgtggacttaattctactggagatgagtgaccccattttaagacaacaggatcacaaattattatcacatatcagcagggcagacaatagctacgacctggggctgaaagcaggtaactctatttattctgcaaaaattctgtcttgattatggtgccagttgctgtgagggatttcctttctagaacctgtttttcacaaggtttgagtctgaactgttaacattctactgatttctgggtgaagggactgactgcaccatcctagcctgtcagagcacttgccccaatacttccactttaagagttttccaccttgtccagaactacagtccactaatcccctcattttctctcttaagagaataaacaggccaggtgcggtggctcacgcctgtaatcccagcactttgggaggctgaggcgggtggatcatctgaggtcaggagttcgagaccaacttcgcctacgtagtaaaacctcgtctctactaaaaaaaaaatcacaaaaattagccgggcgtggtggcaggcacctgtaatcccagctactcgggaggctgaggcaggagaatcccttgaacctgggaggcagaggttgcagtgagccaagactgtgccacagaactccagcatgggcgacagagtgagactccctctcaaaaaaaaaaaaaaaaaaaaaaaaagagagaaaaagagagagacagagaataaacaacccatgtcaagtacacacccacatccctcttatcccaaataccaaacacacaaaaatccaatctgtctccttctacctaagcaattgcagatagtcacattcccataattaccttaagctccctgacttgctgctcgtcctttctctggcaaaatctcatccttggatgagcccgactttgtgtttgctcaatgacaccactcacctgaaccagaaaaaatatcaaaaagtggtcagagatatcatcataaattcaaattacttacataaaaaattggccctaaatgtttccagaaatcaataaaagttttgtttctccaaagacatcatttcttcagaaacccaacgtgtataacctattttttctatgttcttctaacattcattcaacttctctcatctgatatcttgccaaatcattcaaagagaaaatatatcccattagtcaagagccaaccatattcccatcacctgagaaaatcatatgcacaggatgcgcccacctcacctttctctgcctcatgtcagaaaaagtacccctccttttgtcacaaggcaaacctgagataaaagatttagatggcctgtaattccagcactaagggaggccaatgcatgcagattatttgagtctaaaaaagaagcctaagcaacttagggaaactgcatctctcaaacaaatacaaaccattagcctagcatggtggtgtggtggcacatgcctgtagtcccagctactcagggtggggagcactgaggtgggaggatcacctgagctggaaggttgtggctgcagtgagccgtgatcacgtcactgcactccagccagggtaacagatattttttaaaggatcttctctgttaaaaataatcaaataaacaggtggccatgaggctgaggtggctgcagtgcactcaattcctccttaaataacccaaaacttgactcagtgtaaataataaaaggaaacttaagtttaaccagtcagaaaccaccaactaacatctaactagagaccttccactgtaatgttccaaatgaggccactgctccacttcacccaatcaagtattttctttttcttccacattcaccatataaaattcttcccccaccctccctaagcctctctgtgggacctctgagctgcttgcagtctggggctgcctagtttatacatttctgaatgctcaaatatattttctaatgtttcaaagtggctctggtgtaggaggttgttggtggagtgacccgagagtatacaggaattgaggccatatgagatctctggaccctgtactccattttgctgtacactcaatactactctaaaataataatatatctttaaaaatctataactatcacgtagcccttttcaagtctccaactggttggagccagttcgattaaagctcagaaaaaactggttaataagctagttctgacccaactggcaagaagcggcaggaaagacccaggccaggggagcatattgcacatgcatgcaccaggaaactggaggaagcttggaggccctttagcctggtcctgagcccgctgaaactgcagttacaggcacagatgcctggggcaccaatctgaatctgccaacatccaaggccacatgaacacaaatgcacagtctcctctgcgatcggtagctaaggatgttaggccatgattggactaggatgggagatgaactgagaactctggattctgtaggttgttgttgtctcttcccacccccaagcaacaagtgatgaacacacacacacacacacacacacacacacacacacacacatcccgtagtgactaacaggatctccctccaggggatttgcaggaaggggagcagaaaacatcccaggggcctttcacagctacttccttgagccccctttcagacagtgctgtctagacctgtctcagcccaagcatcaccaccctgatacgcagaagctggcatccttacctgaaattcaacatcaagaaatgatctcttctactcaacactgatagaaatacctctaagcaacgtcctcattggcaggggtggagtgggggagtttcttaaaaagtgaggcctctgcctaccacctagagaacctggaaatttccatctgtgccacaaagtccaaatcactggccactgccccagtgtatggcagattagaacatctctccattggatctgggtttctattccattgagtgaaatgccttttctactacaggaacagaataagggatcaaaagggtcttacaactgaactccagtgtacagtctgcacagacactaggcttgtgcaaatatgacacagcgaggccccaggacccttaagccagctgaatgtactgagtttcaggaaacagtgagatacattcagcaaaacagtgggcttcatgctgaaagaagtcaatccaagtaaacacacatctcacacacacacacacacacacacacacacgcacgcacgcacgcagacaccctagtggccaataggtcctctcaccaaaaacctgcgatcaggagagcagaaagcctcccagggctccaccactgccctttctgtagccccttatcagacggccagcctcaggacagcactgtctgatcctggtccagcccaaaccgccatcaccctgtgatgtgggagcaggccacttcaccagaacctctgtggcagaaaaatttctttcttttaaaatgatgagggggaaccttcagacagtgtcctgattagggtgggtggagaggggggtttcccagaaagtcaggcagggcagggcagaagccctctgggttaactgtgtgcttttgatatgaaggcaggtaagactggacaggtgggggtgttagtgaggggatggtgtagggtgctgaagaactccacttgggctctgcgcaccagggaaaatgaccacaaaacatcccatcttcactgctcagagaaggctagatctgctgtgagctaggaagccatgtgggggcagctgatgagtcatcaaatgggagaaatctgagagccatgtgttccacaggcctctggtccttgttcaggcagcagggcactgtgagatgtggctccttggccctttccagccaccaccttgattgcctgctgcaaggaaagagactgaagcccaagaatggggtcttgctcaccataggatgatggctcagtgtgcagagctgagctatggcccaagaggcaaaaggtggggatgacccaggctgagctgggggatccaactgaacatgcacttgctaagaagctgtgggctatgatgccttgggaccccagtctgggtcgagaattgtagcaaaacaggctactggtaaaagttcttgggaagccaactcacttttgctttcatccgtgggcaaacaaacctctgatcaaccacaccacaatggtgtcactctgtaaggcacaggcagacaaggcatccagccttgcacactccagggcccacacatgtccagaatacaatggttcttgttgagactccactcttccaactcagacagaagctccccaatctcctcagccactcccaacaactggaggtctgaaaactttcatgcatgccgctatggtctaaaccactcgtggtggttttgattttcattttcctgataatcagtgatgctgagcacctttccatatgccttttcaccaactggatatcttctgtggctaaatgtctattgaaatccattgcccatttacaaatctgcttttttgtgggcttcttgatgtttttctttttttttttcctatttatttatacaagttccttagatattttggatatttttaaaaatgattttcaattccattgcccagttataaatcttttttttttttttttttttttttgagacagagttttgctgttgttgtccaggctagagtgcaatggtgcaatcttggttcacagcaacctccacctcccaaagtcaagcaattctcctgcctcagcctcctgagtagctgggattacaggcatgtgccaccatgcccggctaatttttgcatttttagtagaggcagggtttctccatgttggtcaggctggtcttgaactcccggtctcaggtgatctgtccaccttggcctcccaaagtgctgggattacaggcatgagccactgtgcccggccaattatccctttttgtggtttttttttggggggggtggggggaagaacagagtctcgctctgtcacccagtctggagtgcactggtgtgatctcggctcactgcagcctccgcctcccagattccagcaattctcctgactcagtttcccgggtagctaagattacgggcgcgcaacacatgcccagctaatttttgtatttttagtagagacggggtttcaccatgttggccaggctggtctcaaactcctgacctcaggtgatccacccacctcccaaagtgttgggattacaggcgggagccaccactcccggccccattttgtgttttaacatcagtcgacactcgtattttaaaataataacaatgaatggcggtaccttagaacaaggtaattatacatctttctcttgtcctagtgcagacattttgtctataaaatgttattcacagatgaattcatgaaaacattactgtgaattttaaatccatatacaagtgtatgcttgttcatgaatacttcaataaaataaaactaatagcaaaaaagaattccagagttgaagcagtttcaggaaaaaggagttggcagtatgaagtaaaatagaaaaaaatgggtttttttttaaatgggtatatttgtgtctacaacttttttttaattatagcattagacaatgtgtatatatatatacatatataaagcaatggaagtggcattgttttcatactagtctaggatattaaaatatatgtaatatgtgattggcaaaataatggccccccaaagatgtccacagattcctagaaccttacatgaaaacggtacatcatgcatgtgattcaggtaaagaccttgacatgaggagactaccctggtgctatggaatgaacgttgtgttccgtcaatgttcatgtgttaaaatcctaaccctcaaggtgatggtattaggaggttaagccttacgggagactctgccctcatgactgggattagcaccttattacaggcacaagggagcttgtttgttcctctcaccatgcgaagacacagcaagaaggaagcctctatgagaaagcaggccttcaccagacaccaagactgccggcaccttgatcttgcatttctcagcctccaggactgtgagaaacgaagttctgttatttataagctacctggtctaatgcatttccttgtagcagcctgtatggattaggacagtgggctcatgtggatgatgacggtgtgtccattcaggactaagtaagcacatgagtccttaacagtggaagagaagggggaaggaaagagccacagagacatgtggccacagaagaagggtccatgggatgcaaggttgctaatggtgagagtggagaagagcccaaagccaaaaaatgcaggcagactccagaatgtggaaaaggcgagaaaaaagatcccctagagcctctagagatgaaggtagcctttccaccacctagattttagcccagtgagatccacatcatactctgacatacaggagtgtaataaatttgttttatgccctgacatagtggtagtttgttgtagcagcaatggactagtaatatataaatatatatatacacacacacacacaaacactacccccccaccacacacacacacacacacacacacacacacacacacacacacacataactatatatatcctacccttcaaaattgaagcagataaactacacattagcattaacttagctgggtgtagtggatcatgcctgtagtcccagctactcaggaggctgagagggaggatcatgtgagcccaggagtttaagatcagcctgggcaaacacactgaggccacatttcaaaaacaaacaaacaaacaaaacacaacaaatctttgattaagctcatttcccaaatttgaagaggagacaattattagataaagaggagaaaagagaaaggtagagctgctgacttttgtggcggaagcagaggcacaggcccaaacatactcctttcctcctggctttcctgtcccttctcataagggacacatgaacctctcaaactgaaccatggatcacagacccatactcagaactcaatacagttttgttctatgattttttacatgtctgtgtccttgcttctgcctcccattcccaactcccttactctagttagaaaaaaatggctattaccaaatatgagtacatcctcatatactaatgccaactgatcatcacctggttttcttcttttacaaagtcataaatctttagactttaacacatcttccaagcaatagaatgttattttccagtccattaacacaaattctatatttaaaatgaagacttcacaagttgatttaaataacatattaaccaacatagactggccatggttcaaactgacattttaattaaatgtgatgataggttgagtaacctagcagtactctaaaatgacttttggttatggctttttccatattatgtttaggctgaggcatccctaaatgattcaactgtaattcctcttcttaaacatgagatttatctttacaaaataatttattttcttaaaattacaagttaattctatagttcatgcatacataatctcagcagatatcagctgtatgtgtacacacatacatataggtatttgtatatacacacattacataatttttttaaaaacttattagtagggtagaaccacgaagacaaagaggctttgtgtaatgtgatggaaacacatttgcaggacgaacaacaggctgctgtgagggctgcatttaccctttctactgtaagacttggaaaaacatggatagtggatatttaatccgcataacagaaatttcagggtgcagaaaacttcccacaatttttacagacaatgtcaacagacaggcattcaatgcagggaatacacagtgtgacagtatacaaaaataagcaggttgatggtttagatttatgagacaagagaaagaaatagatgatgccataattctccttttatggagttatgaaaattgttcattttatataaggtcaggtgctttcaaatgtcaatgagaaaaatatttaaaggaagaatcaaatctaagacgtggagagatctttataaaaatgaccttcaggccaggcacggtggctcacacctgtaatcccaacactttgggaggccaaggtgggtggatcacaaggtcgggggatcgagaccatcctggccaacatggtaaaaccccgtctctactaaaacacaaaaaattagccgggagtggtggtgtgtgcctgtagtcccagctacttgggaggctgaggcaggagaactgcttgaacccgggaggcagaggttgcagtgagctgagagcaccactgcactccagcctggcaacagagcaagactccatctcaaaaaaaaaagaaaagaaaaaaaattaccttcattctgagaaggtataatcatcaacacattcttgagcaaaactacgcacatacacacttccaaattcacaaaccatgcttgtgcacacactgatgtctctagattccttttttgaagagatggcaacttggtgtgtcacccaggctggagagcagtgttaggatcatagctcactgcagcctcaaactactggggtcacgtgatcctcctacatcaggctcctcagtagcctgaactataggaatgagccactatgcccagccaatgttttcatttttttgtagagatgaaatcttgctatattgcccaggctggtcttgaactcctggccccaaggaatcctcctgccttgccctccaaacgtgctgagattacaggtgtgaaccattgtgcccagcaactgtattctttattaagaagaaaatttgtttgctgacatgtaggcaatgaattgataagtaatagttcagaaattactaatttacaagtcaatataaatgaggtgagtaaacacaaaaataacagcataaataaacagttcatgacttcacgtttctttttctcctttaaaatgtagctctgacagagactactacttgtccattccatggaaaagtcagaggtggttaaaatgtcagaggtacacttactaatactttgatgccttttgtgtagcttcttctcagtacttcaccagctgggattgacacacctctacaggtgggttcaggagccagacagcagcacacagaatggggaatccaaagccatctctgacactaaaagcaatgaaaacaaaaataaccaaacatattatcaagaaatgaacaagagattgatatcaagtaaagcaagaagagaagaaagcatttaatctgccaggctttcattctgacaaaataatttacaacatgcatgtctctatctgacatgagtgaatagaaaaagaacccaaatacccagttgaattgcaagatgaaaatgaaaaagaactcttgcttattcgccagggtacaatctaatctgggctactaaaacactttcatgcactgattctatgtaacacatgctttattgccatttggaaatgggatttcttgctttgatttaaatatacttccttggatttctgctttaagtatactttcttaaacatattcacagctacattctcagtacaaattttcaggtgtaagtaactacttctgcttttgatagtataattggtgaaataagctatacttccatgtaaatgtgagagtacaaggtaagattccagagtcaagtaaaacataacagtcaagaaaataaaaaggtgagagtaactgggcagtggggaaatcttgtgtgtggaaagaatgaatctgtaaaactgttctttcctaagagagttcagcaggatttggatgatagagagctttgtgtacaagggttccagttccacatagtttaggtctaatttcaaaggcaacttctagtgcaacctgtgactcacgctgtcctaaagtgccaaatgtaaagggtctggagataacccacaagcagcactgtgaacccctgacagcaagcctttccagataaatacctgtcagtgtctatagctgatgacagagcagaatatctgaaaaataatacttcttcggccaatggactgccagtcactattatttagtgtaaaatactatattacatatgtgtaattttttaaattgcagtgtttcacatcgaagcaactaaatataaaaaccaaatgtttattcagcttaaaggcaacttagaaatactgatcccagatagaaagatgctttagtcccaagtcagctgttctaaaatgccacaactaaaccaacgaagggatcttgaagcatagtaagtgttcataccttttcagctatacctctgcttgtcttgaatataaaaacctaagctgcagttatgccacagcacagaatgtgttatattttacatcactgagccttagttttacaaatggtaaaaaaatagggaaggtaaactgaggttttcttaaggagctgttacatccaagagactcgtgaaaatctttgccaaatgtccccggtacatagctcctccccactgatgggctcaacggggagaagctatgcacatgtctcaatctgcatatgctcaatggcaatacaggattcctaggataaagtaagggatataaatgacacagcacactgaaaagactgtaatgttacttcagaatgttgcaaaataaagattacagatgaaagttttagttcactgaagcatgtagtcatgtatatttcatttgtgtgttttaaagtcttatactgcttacattctctttttttgtttgttttaaaataattatatttggctacaaagatcaataacaaggatgatgtcagtccaggttggacaggcagttctggggcagatgttcttgcagtatttttttttttttttttttttttttagtatttattgatcattcttgggtgtttcttggagaaggggatttggcagggtcataggacaatagtggagggaaggtcagcagataaacatgtgaacaagggtctctggttttcctaggcagaggaccctgcggccttccgcagtttttgtgtccctgggtacttgagattagggagcggtgatgactctcaaggagcaggctgccttcaagcatctgtttaacaaagcacatcttgcacgctcttaatccatttaaccctgagtggacacagcacatgtttcagagagcaccgggttgggggtaaggtcatagatcaacagcatcccaaggcagaagaatttttcttagtacagaaagaaatggagtctcctatgtctacttccctccacacagacacagcaacaatccgatttctctatcttttccccacatttcccccttttctattcaacaaaaccgccatcgtcatcatggcccattctcaatgagctgttgggtacacctcccagacggggtggcggccgggcagaggggctcctcacttcccagaaggggtggctgggcagaggcgccccccaccgcccagacggggcggcagccgggcggaggcgccccccacctccctcccggacggggtggctggcggggcaggggctgccccccacctccctcccggacggggcagctggccaggcgggggctgcccccccacctcccggacggggcggctgtcttgcggagacgctcctcacttcctggacggggcggctgccgggcggaggggctcctcacttctcagagggggcagctgctgggcggcggggctcctcacttctcagacagggcagctgccgggcggaggggctcctcacttctcaagacacggcggctgggcagagacgctcctcacctcccagacggggtcgcggccaggcagaggcgctcctcacatcccagacggggcggcggggcagaggtgctcccctcacctcagacgatgggtggccgggccaagacgctcctcacttcctagacgggatggcagccgggaaaaggcgctcctcacttcccagactgggcagcccgggcagaggggctcctcacatcccagacgatgggcggccaggcagagacgctcctcacttcccagacggggtggcagccgggcagaggctgcaatctcggcactttgggaggccaaggcaggcggctgggaggtggaggttgtagctagccgagatcacgccactgcactccagcctgggcaacattgagcactgagtgaacgagactccatctgcaatcccggcacctcgggaggccgaggctggcagatcactcgcggttaggagctggagaccagcccggccaacacggcgaaaccccgtctccaccaaaaaaatacaaaaaccagtcaggcgtggcggcgcgcacctgcaatcgcaggcactcggcaggctgaggcaggagaatcaggcagggagggtgcagtgagccgagatggcagcagtacagtccagcttcggctcggcatcagagggagaccatggaaagagagggagagggagaccgtggggagagggagagggagaccgtggggagagggagagtgagagggagagccagaatttcctttttacaggcagaataatattctatgtatataccacatttttctttttttgagacagggtcacctaggctggagtgcagtggcatgatcacggctcactgcagccttgacctccccaagctcaagtgatcttcccacctcagcctcgggagtagcatgtaccaccatgcttagctcattttttgtatttttagtagctatgttgtccaggctagtctccaactcctgggctcaagcaatctgcccatttgcctgcattggcctcttagaatctatctttttttttttttttttttctcactctgtcgcccaggctagagtgcagtggcacaatgaaggcacactgcagctttgacctcctgggctcaggtgattctcccatctcagccttcccagtaagtgggactacaggtgcccaccaccaagactggctaattttttgtatagacagggtttcaccatattgcccttacactcctggactcaatctgcccacactggcttcccaaagtgctgggattatagacatgagctaccacacccagcctgtatggctgttgtgaataatatgctgttatgaacatgggcacactaaacaccattcaacttaaaaaaataatcaaagccttaagaactgaaccaaaatggcttaggtgaaaataaaataccaaactctgctctaagaaaaggaaagagcattcactgaattataccttcagcaataagcacttaatggaacttgtttcatttaaaatgcaccacaatcctgtaaattgataatcataccgcaattttatagatgagcaaggtattaggcggacctttttcaaaaggtcatacagctagtgacaaatatttccaaatttttcataacatttctttttttgagacggagtcttgctctgtggcccaggctggagtgcagtggtgcaatctcggctcactgcaagccttgcctcccaggttcacgccattctcctgtctcagcctccctagtagctgggactacaggcacccaccaccatgcccggataatgtttttgtattttcagtagagacggggtttcactgtgttagccaggatggtctcaatctcctgacattgtgatcctcccgccttggcctcccaaagtgctgggattacagacgtgagccactgtgccaggcctaacatttctgttttaaatagcttaattaactacacatgttctatattcttgcctctgaaaggcagctttttttgttgggttggtttattatgcatcagacacttgatttgctgaggaattctgtttttcagtaattcatccaccacaaatatcacgtagcattttgactccacagacctaagagtcttaagtcttaaaaggattgtaaaatctaagtttttctgagatatctgagagtaagaggcttttttctattgaaaataggttgcatttcaaactttatctgtaagagctcacaacactttctccaacatgcatgcccatgtgatcacttaaacagaactctgagtgagacagtaaatacctcatatgcccttgaaaattttaccttggcatagaaaaaccttgttaagaacctaaaaataatttcactttgaaagtctttagggttagacaaatgttaaacttcaattggcagtacaagggcagcactcaagccagcaagagttttgttgggccaaattatgttgaaaaagatcaaatattttaaaaacaggagatttcacataaaaatctgggattccagcttcttctgaataaatgaggtacactaattatgcagagtggcaaatggctggagttgagtgggaggtgtttctagcccaacagataggcatggaagctccagctcagccccctccactccattttcttacacaagggaagccactatggtatagcatctaacttaaggcatattatatgtattcttaagacagaggaaaaggctgaatatttgatattgtcaaaagaaatgagagtctaactttctgtggcaaggaccttcttgcagtagtcacataacatagtctggaacacctccaacataaattatgaaaagaaagctcttggctcagaagagaaaaagcaaaaaagaatactcattaattctatgtcacaggacaaatagatttcaatttccattgcaattgtagaagaggtaaataatctgctgacccagaattccaacagggactcacacttcctgtcttaataactcgaaacactgaaatcactctaacaaaggcaaatcaatgtcttattaatttctggttaaaaaatagacccaagaagacagggcacagacataaattttgtgtggtgggaatacgaatataacttcaacgtccagattcatggatttggaaatgaccttgggcactctaagtatagcaccactgaagtttacatttagggaatggctaatccctgctgatctaaactatttccaatccccaatgtactctttaaatacagaaatttaaaaaaagagggggccgggcgcggtggttcacacctgtaatcccaatacttgggaggccaaggcagggtggatcgcttgagctcaggagtttgagactagcctgggcaccatggtgaaaccccgtctctacaaaaaacacaaaaaaattagccaggcatggtggcgtgtgcctgtagtcctagcatcttgggaggctgagatgggagcatcacttgaacccaggaagcagaggtggcagtgagccatgatcacaccactgtactctagtctgagaccctgtcaaaaaaaaaggaagggctcaacatagtaggtacagagctattttaatagaaagatcatgagggaaaaactagcagctgtcagatagagagtaatttattttattcatttatttatttttatttttatttttttgagacagagtttcgctcagctgcccaggctggagtgcagtggcgcgatcttgcctcatggcaaccaccatctcctgggttcaagcgattctcctctctcagcctcccaagtagctgggattacaggcacccgctatcatgcccagctagtttttgtattttagtagagatggggtttcatcatgttggccaggctggtcttgaactcctgacctcaggtgatccacctgcctcggcctcccaaagtgctaggattacaggtgtgagccaccacacccagcatttcatatttcatttctttcatttcaagatggaaactcactctatcaccccggctggagtatgccactgcacctgacatttcattattcatttcatttcattatttcatttcttcatttcattgcacccagcatttcattattcatttcattatttcatttcttcatttagtttcatttcatttcgagatggaaactcgctcaatcgcccaggctggagtgcaccaccacacccggcatttcattattcatttacttcatttcatttcgagacaagagacttgctctattgcccaagctggagtgcgccaccgcacctggcatttcattattcatttcatcatttcattttatttcatttagagatgaagactcactctaccgcgcaagctggagtgcaccaccacacccagcatttcattattcatttcattatttcatttcatcatgtcatgtcatgtcatgtcatgccatgtcatttcatttcgagacagagactcgctctatcacccaggctggagtgcgccactgcatctggcatttcattattcatttatttcatttcatttcacccagcatttcattattcatttcatcatttcatttcatttcgtttcatttccagatgaagacttgctctattgcccaggctggagtgcgccaccgcacccggcatttcattattccattttatcatttagtttcatttatttcatttcatatttcatctcatttcatttcatttcgatggagactcgctccattacccaggctggagtgcgccaccacacccagcatttcattattcatttcatttcacccggcatttcgtatttcatttcatcatttcatttctcacttcatttcatttcatttgtttcatttcatttcgagacagagactcgctctatcgcccagtctggagtgcgccaccacacccagcatttcattattcatttcatttcacccggcatttcgtatttcatttcatcatttcatttctcacttcatttcatttcatttgtttcatttcatttcgagacagagactcgctctatcgcccagtctggagtgcaccaccacacccggcatttcattattatttcattttttcatttcatctatttcatttcatttttcaatttcatgacgtagactcgctctaacacccaggctggagtgcacccagcatttcattattcatttcatatttcatttcccatttcatttcatgacagagactcactctatcacccaggctggagtgcgccacccacatttcattattaatttcattatttcatttcatcatgtcatgtcatttcattctgagatggagactcgttctattgcccaggctggagtgcagtggtgtgatctctgctccccgcaacctctacctcctgggtacaagcgattctcctctctcagcctcccgagtagctgggattacaggcacccgctataatgcccggctactttttgtattttagtagagacagggtttcaccatgttggccaggctgatcttgaactcctgacctcaagtgatccgcccacctaggcctcccaaagtgctaggattacaagcgtgagccactgcacccagcatttcatattccatttcatatttatttcatcatttcatctccttcatttcatttcaaaacggagtctcactctatcacccaggctggagtgcatcaccacacccagcatttcattattcatttcatttcattatttcttcatttcatttcatttcacctggcatttcattattcattatttcatttcttcatttcatttcatcccatttgagatagagactcgctctatcacccaggctggagtgtgccactgcacctggcatttcattattcattgcattatttcatcatttcatttatttcattttttcatttcatttcatttcacccggcatttcattattcatttcattatttcatttcatcatttcatttcatttcattttgagacggagactccctctattgcccaggctggagtgcgccactgcacccagaatttcattattcatttcattatttcatttcatcatttcatttgatcatttcatttcatttcaagacagagactcgctctatcacccaggctggactgcgccaccacacctggcatttcattattcatttcacccagcatttcatatttcatctcatcatttctcatttcatttatttcatttcatttcaagacggagacgcgctctatcacccaggctggagtgcgccaccacacctggcatttcatatttcttcatttcatttattccattcccatattcccattcccattcaatttcaatccatttcatgacagagacttgctgcattgcccaggctggagtgcaccacacgcatttcattattcatttcattatttcatttcaccatgtcatgtcatgtcatgtcatgtcatttcgagccagaggcttgttctaacacccaggctggagtgcagtggcgcaatccctgctcactgcaacctctgcctcctgggttcaagcgattctcctctctcagcctcccaagtagctgggattacaggcacccgctatcatgcctggctagtttttgtattttagtagagatggggtttcatcatgttggccaggctggtcttgaactcctgacctcaggtgatccaccgtcctcagcctcccaaagtgctaggattacaggcgtgagccaccgcacccagtatttcgtatttcatttcatttcatatttaattttgtttcattatttcatcatttcatttcaagacggagtctcactctatcactcaagctggagtgcatcaccgcacccagaattttattattcatttcaatatttcatttatttcttcatttcatttcatttcatttcacccggcatttcattgttcattatttcatttcatcccatttcatctcatgtcatctcatttcatttcgagacggagacttgctctattgcccaggctggagtgcaccactgcacctggcatttcattattcatttcatcatttcatttcatttcacctggcaattcattattcattttattatttcatttcatttatttcatttattctcttcatttcattccatttcatttcgagacagagacttgctctattgcccaggctggagtgtgccaccacacccggcatttcattattcatttcatcatgttatgtcatgtcacgtcatttcattctgagacagactcgctctatcgcccaggctggaattcagtggcgcgatctctgctcactgcaacctgaggtcgggagttcgagatcagcctgaccaacatggagaaaccccgtctctactaaaaatacacaaaattagccgggcatcgtggtgcatgcctgtaattccagctactggggaggctgaggcaggagaatcgcttgaactcaggaggcagaggttgctgtgagccaagatcatgccattgtactccagtctggccaacgagagtgaaactctgtctcaaaaaaaaaaaaaaagtgatggtagatgctcacactggcaaacgttagcaagtactagaagggtcatttggcagtagtcattcacgttttaagcatgcagataatttgctcaaataacttaatttttagcaatttatcctacaactaaaatgtatgtgcaaaactgtatgtacgacagtgtttaagagaaggcctcaaagaaaaggtggtatctgaacaaagatggacagatgatgcagcatttgaggtaggtatctggaaggattgttctaggaaatggtaacagcaagaataaaggccctgaagtgggagttaaaagacaatgggaataggagtagaatctggagtcatcaaagtggcaagggagcaaattacagagaagatagagccactttaaagaatctggcttggcccggcctggtggttcacgcctgtaatcccagcactttgggaggctgaggtgggcagatcatgaggtcaggggatcgagaacatcctggccaacatggtgaaaccccgactctactaaaaatacaaaaattagctgggcgtggtggcgggcatctgtaatcccagctacttgggaagctgaggcaggagaatcgcttgaacccaggaggtggaggttgcagtgagccaagattgtgccactgcactgcagcctggcgacagagcaaaactccgtttaaaaaaaaaaaaaaaaaaaagcaaaaaaaaaagcttaattggattttgattgctaccttctaaatatcagcactttcatttaatcataagcctcaaagggtttataaaacttctaaagagttaagtttcataattctcctaacgagagtctacacatactgagatgttaatgcagggtttagaaactgtcaaaaactttcataagaccctcaaagagatctaggacaattcctcccacccacagaaaagcaatcacccaaacaactgagaatcagtggcaaaaaaactctcctaaaaggacacagtactatggggagtcaaaaacaattcagacagctgggcacagtggctcatgcctgtaatccagtaactcaggaggctgaggtgggaggattgcttgaggccagcctgggtaacatagcaagaccccattgctaaacaaaaaaagaaacaatgaaaaaaattagctgggtgtggtggcatgcacctgtagtctgaaccactgggcaggctgaggtgagaggatcctttgagcccaggagttcaaggctgtagtgagccatgatggcaccattgcactttagcctgggtgacagagcaagaccccaactcaaaaaaaaaaaaaaaaaaaaacaagggaaacattttagtgagtttagtcttgcctggaagagacaagtaagggacagatgggggcagtggtgagggagcccaggacagctagctgctatgctattcaaagtcacatatattgcttccacaatataacaaaacagagaaagaaaccaccaaacagcaaaccgtcttctagtgatcccatcatttttttttctttttttttttttttttttttttgagacagagtttcactcttattgcccaggctagagtgcagtggcgtgatcttgcctcaccgcaacctccacctcccaggttcaagcaattctcctgcctcagcctcccgagtagctgggatttcaggcatgtgccaccacacctggctaattttgtatttttagtggagaccggatttctctatgttggtcaggctggtctcgaactcctgacctcaggggatccacccgcctcagcctcccaaaaatgctgggattacaggcgtgagccaccgtgcccagctgacccaatcatctttcacttcaaccttttcctcaccatctcttcaactaatacttttcctggaccattttgactttaggcttctacctccaatctattttatctacccactacttctaacttaatcttcctcagagataattctaatactctgtccaaaaacctttgatgacatgctgcctttctatgtaattttaagcttcttaccttagctttccatgccataagcctaaactatcttcccagacttttctcccacaccttccttatatgtatcgtataatcaaacagatacatcagaaaattcagtccatccttaaggtctggctcaactgttatttattacttctttcccttttctagaaattttcctgatttctctgtcctggaggtaatttggtttggtgagaaagacaacgggctttggactcagactagagtttgatgcactagaacatgacagagctgtgtgagcatgtggaggtaatttaacttgtctgaattttagtttctttgtctataaaacaagggagtaccagtctactaccttcagagaatggtaaatgagctgacctatataaaggatgtgacctcctttctactttaagcgtattttgtacaatttttagcggagttaacacagctttcctcttggaagtcaacagacaatatgtaagactgaaaagtcaagaaaaatcaagataataatattatttaaaaacatgaaaataaaaaataatgaattaaagcagcctaggcatggtagctcacatctgcaatcctagcactttgggaggctgaggcaggatgactgcttgagcccaggagttcaagaccagcctgggcaacatagtgagaccccatctccaaaaaagaaaaaaaaaaaaataattagctgggtgtggaggcgtgtgcctgtagtcccagctactcaggaggctgagatggatcacctgagcccaggaggtcaaggctacagtgagccttgattgtgccactgcactccagcctggatgacagagtgagactctgtcttaaaaaaaaaattaaaataagctgggagtggtggctcacgcctgtaatcctagcacttgggaggctgaggagggtggatcacctgaggtcaggagtttgagaccagcctgaccaatatggtgaaaccccgtctctactaaaaatacaagattatttttagtacaagatcttcttaggattatttcctggacagtatatagtgatgttacaaccccagtgatttaaagcagatctctcaaagcaaaggaggaatgagcttttgtcaggatgctagtggcatgtccttagtattagaggaaaacaaagaactagattccttttgtttgcccccaaatcctttaacctctgagacttactataaatgatttacctgtttacactatgtcattgtgttctctctgggtaaggctcttaaggccttccacccaactgaatcaggcccacccagattatcgcttacttaatgcaaattgtattgaatgtggctaagcacagtggctcatgcctgtaatcccagcactttgggaggccgaggtggggagatcactcgaggtcagtagttcgagaccagcctagccaacatggtgaaaccctgtccctactaaaaatacaaaaattagctgaacatggtggcaggcacctataatcccagctacttgggaggcagaggcaggggcatcacttgaacccaggaggcagaggttgcagtgagccaaggtcacatcactgcactccagcctgggcaacagagtgaggctttgtctcaaaggaaaaaaaaatgcttattgaatgcaataagattaactcctttacttgtagactttgatcacatctataaaatactttcacagcaatacccgaattagtgtttgacagaataactgggggctgtagcctagctaagttgacattaaaaaaaaaaaaagactatcacaaaactaaaggtggaaacaatccaactattgataaaaaattaacaaaacatttgccacgatcacacaaaggaatactccttagtaataaaagggatagaaccactgacacattaaaaaacatagatagatctcacattacgctaagcaaaagcagcaagatacagaagtgtgtatgacatatatttacatgacattctaaaaaaaagaaaaaagtaatttataatgaaaagaataaaaattatggttgtttctggggttggggactgaccagaaaagggctcaagggaattttctgaggtgatagacatggtttttttttatgtcttgataggggtgtgggatataaaagcatatcaatttgccaaaactcaccatattatccacttaacattgtatacttcaatgtgtgtaaattttacttcaaaaataaaagaactgtaaacaagtaatgaactctatttaacaggtttactttttgcagtggcatggtttagaagttctgaaatcaccttttgtatatattaggcttaaacaaatgagaaaaattgaagatattgggaaccacattcttcattgttggagaagagagttccaattatggaaagggggaaagactataatataggctgtgatgctggttaagaatgggaggtatcaatataaattcacagttgtatatgtgtgtgtgtgtgtgtgtgtgtgtgtgtgtgtaacatatatgttctagttcaaatcttggcttccaaaactaactaaaatccaggaccacctgcagaaatggctgattccagagctggtgcagggaatatacaagatgagcctacaacatctttttgtgctaaaaagatggagatgctcaaagaagaaagtgcattaaagaatgatgggcacatgtcaaaggcacacaatagttaacttgaaggcattcccactgatggaatatgggacaatttagcaccaaacagaaaatagcaatggatcataatccactgaatacaataagaatgcaagtgtctatacttgcatatatattaataaataataaatattaataaataagtatacacaaataaggaaaaagggaaaattcttccttatagtagaatgccaactactaaatgtagaaagaatgggagtttaaaaaattagcaatgactgctaaaattagtaggtgaaggttttatgaggacaagatgtttacagtttcaaagtatataaaatatatagcgatacattaattacagaatgaaaaagtataacctgacagtggaggaacctggtcaacccaacttaaccaagtcattacactggtgtcacaaatattgggacaaagtgctatcacatgtctcctcaaaagatatactaaatagaacacagtatcacttcagtgggattcctaccgaaatgaataacctgaacctaattaggaagaagcagtgggcaaacacaagaaggacaatctacaaaataactagcctatccactttagaaatatcaaagtgaacaaacacaaggaaaagctgagaaatggttccagtttaaagaataccaaggtatgagcctggactaattgaagactggaaagaaagctacaaaggtcataattggaataacaaaattatattataatatagattaactaacagtactgtatcaaattaaatttcctgattttgataactaactgtgctgtgctgatgtaagacaatgtcctagttcttaggaaatatacaacaaagtatttagggataaaagggcacagtatctccaacatattcctaaacaattcaagaaaagaaaatagagaaaatgatgaagtagatgggacaaaaatgtaaactggtgaatctgagtaaagagtatatggaaattccatgtattattcttacaacttttctgtgaatctgagtaaagagtatatggaaattccatgtattatacctgcaacttttctgtaagtctgaaatttcatatacatacacataaaaacacgtaatataaggccgggcggggtggctcatgcctgtaatcccagcgctttgggaggtcgaggcgggcggatcacaaggtcaagagatcgagaccatcgtggccaacgtggtgaaaccccatctctactaaaaatacaaaaattagctgggcgtggtggcgtgcacctgtagtcccagctactcaggagaggctgaggcaggggactcacttgaacctggagggtggaggttgcagtaagctgagattgcgccactgcactccagcctggtgacagagtgagactctgtctcaaaacaaacagaaaaacacacaataaaaaccacataatataaataaagctatgaaaatactctattttcatatatgattaaaaatttccagaatcaaaagttccaagatttaaactcaatactagagtttccagtctattatttaatatactacttctaaaaataatttgtattttaattattagacatttatctagaattttggacaagatattcatgctaaaaatcaagaaaataactagaaaatttatgttatttcttttatgaagcattccttgacaccataagtagggttgattgttcttcctccatgctcccaaggtattttgcacataacattggtagagcacttagcatattgaattgtaatctgaaaatcaattgcatttccacatagtagcaatgaataattaaaaacagaaattttaaaaacttacaacagcaacaaaattatgaaatacggataaatctgacaaaatggggaagaattatacaatgaaaaccataaaatactaatataaaatactagtgagtaaaactgacatgaataaacagagacatacatcctagacatgtgtcaaagacaaaacattgttaagatgtcaattccgaggtgggcggatcacctgaggtcgggagttcgcgagcagcctgaccaacatggagaaaccccgtctctactaaaaatacaaaattagccgggcatggtggcacatgcctgtaatcccagctacaagggaggctgaggcaggagaatcgcttgaacctgggaggcagaggttgcggtaagctgagatcacgccattgcactccatcctgggcaacaagagcgaaactccgtctcaaaaaaaaagtcaattctccccaaacagatctacagattcaaagcattctcaaaattcagcaagctgttttggtaaacattgaaatactgattctaaaacttggcaaaatgactctgaaggagaaaaaagttgaaggacccatactacctgattttaagacttattataaagctatagcaaccaaaacaggaagaaagaaaacaacacattaataagcttacttcaaaacttaaaacttctgtgcttcaaaagtcactgtgaagagaatgaaaagacatgctagaaatatctgataaaggatttatatccaaaatatataaagctttcaaaactcaattaaaacaaaaaacaatgaaaacttaaacaaaacatagcttcatgggtgtagtcatacgtccaaacttacataattgtataaacaaatagtttattttatgtcaattatacctcaataaatctgtcttaagaaatggaatctgactccctcactagactctcagctcctcaagggcagggattataaattataggcggggtgtgttggctcatgcctgtaagcccagcactttgagaggccgaggcaggaggactgcctgagcccaggagtttgagaccagcctgggcaacagaatgagaccttgtctccactgaaaattaaaaaaaaaagttaggtgggtgcagtggtgtgagcctgcagttcctgctactcaggagtttgaggtgggaggatcccttgagctcaggaatttggggtaacggtgagctaggattgtgccactgtaccctagcctgggtgacagagatcctgtgtctaaaaaaagaaaaaataaataatatttttatctacattagcatcttgtaatgcaagaatataaaagcagttgagtaagaacttgccgaataaacataataattaatgagccaaagaaatttaactgatgattaaaacaatgagtccagaaataatccgaaggcactacataactgacgcatactaaaaattcacatctacaataaatgcatggtatggtaaaaagagcactgcactgagattaggaaacgtgagaaactcaaagtggatcttcactagctaggtgaccttagataaccaaacctcactggacatcattccatcatctgaaattcagggttcttaataattcttattttgtttacatcatagaattccttgggaaactaaataagacaagtaaaaaattcattcaaacccacaaagccatcagtattggtgtcattagaaataaattttttaagggggtagagaaaccacagatacgtgattctatttactcgagggtgaaaagcaacctggtctacttgcctgataggaaccaagacagcaaggactactccttcttttctgttttctgcctagcggtagacaagcctcgtttttcctgttcataaaaagacaaactgcctattctgatctgttaactcggaaaacaaatacttgttctgtctttttaaaagaaagtggctgaaaaatataacatatcaattatcatgtttctacttcatgttaatatagtttcagtgttcttctctgagaggaacaaggttagatttacttccttccctccttcatgggaaataaaaaatacacatacaaacacttttgtactaaacaagttaaaccctgggttttctaagtagacaccttttaacatgccaactgtctccttcgaaaaaagtgaatgcccttaacttgtttaaaatttaaattaatgaactatgatgaaaatataaaggtaaactggtaacagctactgagacagaagactgaatgacctttgtgatagctctcactagggatgggcctttaagacttcatagtcaaagaccttcacttaaggaaaaaactagaaggaatccattaaaatcttatgaggaattcatgacctcttcatgattttttagatttagtagtaagaaacatggttattttcccttattaggaataagagtttgtaacgatcatgggaaaaaacattcggagattaaaaaaaattctacttaccaatggattgttcccttggaaagcaggtttatataaacaccattttacccaaattttattagcatcactcaaacagtagtgattatgcagtaaatagaaaactcttgcttttaattctaatgattattaaaaacttagaaaagacaagcataaaaacgtttaatttccaaacatttttggaaaactccaactgaatttggacctttcccaatgagctggtgtcttgacaggcacctctagtactttaactctagaagatgtcaccagtactataagcaatggtgtctacttgttatcatttctatcagctctgctgacatttggaaaagatgtaaagatttgtgatgtctgggataatctgattcactagaggcaggttttacgttaaatacaggaatactctgcccagtaggtttcatgtctaggcacctggtttatgtgctcaccaaacagaagcagaaaaacaactctcagaaaacttaacaccctttagtattgaaactattttctggatgttgtacagaaacaagtaagagaagacaaaaaaaaaagaagaaatgggaagattggaattttaactctttccctctatctatacttactgaaaggtttttaactcatggctgccccaggcaggatcacaacaaacagagggataacactgtctgtataaaagtatttgcctgtttgcatgacctgtttcatattcttttaaaataatgataccaaccagatgtcccacaatgatgataaatttaatttatttccaatttctcaaactcttctacagattcaggcagcacagtcacagccattagctcactgagctggatgcatcattgaaggaacagaattgatcaggcagatagattgcagtgcatggctaagagtctcctaaggagggagatggcagaaatccagacatcaaatagatgatgaaatggccatttccattaaggtaacatcacatcacagatattaattaggaggcactataataaagttaagtggatgtggggggaaaatgctgagttaaaagtcaccccatatgtccttagcctgaggtaattacagatctgaaggtgagtcatggatctgcaattttccattcattttacaatagctgcaggaacgtttagagattacgtaaaaggagattagaatccttttttagactggggacaaattatctttaaaaaaagaaaatattcttatgttttccttttaacattcctgttttattcccaaggaaaatgacatcctttatttacattaacattaatggaggatgacaatgtactgactactttcttcttcttcttcttcttttcttttttttgagacggagtctcactctgtcactcaggctggagtgcagtggcacaatcccggctcactgtaacctctgcctcccacgttcaaaagattctcccacctcagcctcctgagtagctgggactacgggcacacaccaccatgcctggctaattttttggatttttagtagagatggggtttcaccgtgttagccaggatggtctcaatctcctgaccttgtgatgccccctgcctcggcctcccaaagtgctgggattacaggggtgagccacctcgcccagcccagttcttactactttctagagaaattaagcaaatgaaacaagttagctttaagtttaaatgcattttaccaagttttttatttcaagaatgtaaattcatcttaaaaactgatgggatattttgttctcagtgttcaatccaaatctaccttaagagctaaaaaaaaaaattttttttttttttgagacagtctcgctctgttgcccaggctggagcacagtggtgcgatctcggctcactgcaagctccgcctcctgggttcacgccattctcctgcctcagcctcccaagtagctgggactacaggcacctgccaccaggcccagctaatttttttttgtatttttagtagagacggggtttcaccacgttagccaggatggtctcaatctcctgacctcatgatccgcccgcctcagcctcccaaagtgctgggattacaggcgtgagccactgcacccagccggaataacaatcttttaaagtattatttgatgtacgtaaatgatgaagacagccatattccaaacctgcagagcttccctacaatagtatgagaccaatagccaaagtgctggttgctcaacaatagatttatgccagttttttttgttctgtaattccttgcaatcttatctcccctagtaccttgcccaattatatacctcccacgtgcatccatgataactaacaaatgcagacagatggccaaaatgtgagttgaggaagtgttgagtacaaaaggagtttatctttccatttcagtataatttggatcataatctcagaattctgaatgcagtactccaagtcactaacttcaaatggctgactgaggctctgtccaggaaaaaaattcctttgcggaagttccaatcttaatttcctacataaactcagacaatttacaattttttattttttgccttacttcaccaaaaaagcagaatcacagggataaaaatttacataggatgtctaaatgatgtagaataactcattgaaagctcctttatccacgggtgcttacaaaagataaaaagatatcagtaaaaaatggtgcagtaaaaacctctgaaaactctctcctccatgaaagcaatgtgaacactgtgatgagcactgtgagaatcaactgaaaagtagccaaaggcttgcagcaatccagggagtgcttattcaagaaaaaccagctgaatcttggtaaaaacaataaactttgcagtgttttatttgccttattcccatcccactctcccaagctccatctcggccttaaaaactaaccttcctgaatcacagtgaaaatcagaagccatcagagggggcaaaagaaagctgaagctccttcaaagcccaattctcagagaactgtcattatttgacctgtctggtggtcccctggagggccccgctcagaaggctgtctttactttacaggacttggagcttggccagtaggaaaagcataattcttttgagggtttgatgaaaacaattacagggattgtttaacactgaaacttcttgaggtggtggcaaacagctggggcaaacaataggctaaccaaaagcttcaaaggaaaaactgaagaatgagaatgtccacaaagggctttgaaaagttctaatatattaaaacaagaaggaatctagagggctcatgcgtgcccatggccatatgaatgctcaggaaaaactagagaaagccctcagctctctcctctgcctgaccttgacaggaagtgaaggctaaggcagaggcatcaactgcttagtgcagtgttgaaggtaggctgcacctgcacatacagcccttcaacaaagactattagacttcgttgagacttattagtttcaggcatctaaggaaatctgttcaagcattagctgactactaatctaacaagcagggacttcactggccacacacagaaagaacacagacatcacaaaattagtttagaaaagtcattgaaaaaacagcaagaaggatgaactgtgatgaaaagagaaaatctgatttccagggtcacattacattattttaaatgtccagttttaaatgaaaattagaagacatggaaagaaatgagaaagtatggcccatactcaaaaaaaaagcagtcagtagtaactgcccctgaggagcccagatgttggacttagtagacaaagaatttacatcagctatttaaaatatactgaaacaactaaagaaaactatgtctaaaaaactaaagtataagaatgatgcctctcaaatagagaatattaataaataaagggatagaaattataaaaaataaacagaaatttgtaattgaaaagtacaataactgaaataaaaaattcaccagtgagattaaaagcagtttagagcaagcagaaaaaacaaccagtgaacttgaagacagggcaattgagactgagcctcaggaacaagaagaataaagaatgaagaaaaataaacagagcttctgagacctgtggaacatcaagtgaatcaacaaacacgtaatttgggagtcccagaagatgaggaaaggggaagaacaaacatttgaagaaataatggcccaacatttaccaaatataacaaacattagagaggttcaaaaaacttcaagtaggataaagtcaaagagatctgcatgtagacacaccatattcaaaccattgaaagtcaaagagaatcttaaaagcaaaacataagaaaatatactcttctgaaggttgtctacaaatctatctgaggcacagtgtggcttcaagattagactttggagtcggttttgtcatgtatgtctttggaggtaatgcggttgggtacacattttatataactcatggggaaggtttttctcctattataatttttgggaataacaataaactaaattctacaacccaggtgagtgtttagaccccgaaactcatctccaagcagtaacagattctaagtggaaataaaaaatccactttttcaggaaaaaaaaatagtaccagcaactcatggtgcattaacggcacttatgtgggaatattcttttacgtacttgaataaaagactcaacttacatatggtgcctgattaagagtttcttaagagatatgaggtaatcatcatttttcttgatagcttattcaaagaaaatactgttacatagtgatctcagtctgaagaaacaaaaaaaaattaaatctctataacagacctaaagcatacacgtgactaaatttcccccctcctcctcccatattagcgtaaagaaatcaagaagaacaagaagaaacaccaagataatcagacttttttttttttgagatggagtcttgctctgtcgcccaggctgcagtacagtggcgcgatctcagctcactgcaacctctgcctcccgggttcaagtgattatcctgcctcagcctcctgagtagctgggattacaggcacccgccaccgtgcctggctaatttttgtatttttagtagagacggggtttcgtcatgttggccaggctggtcttgaactcctgacctcaggccatctgtctgccttggcctcccaaagcgctaggattacaggcctgaactatcgcgcctggccatgataactgaactttttcttttaggattcaaaatagggtaaacaaaaggttactgatttctctaaatactgttcctatgcttcttatatttacacaatgtcttcatactaaagtacaagaaaccacttgaaaattatttttaatagaaacaaatcactctcaaatggaagaattacaacagaatacatactagaggcatatcactatgttcttcttaagagcattattatgtcataaaatttcaaactgccaagcgtggtggctcacacctgtaatcccagcactttgggaggccgaggcgggcggatcacctgaggtcaggagttcgagaccagcctgaccaatatggagaaaccctgtctctactaaaaatacaaaattagccgggtgtggtgacgcatgcctgtaatcccagctactcgggaggctgaggcaggagaatcgcttgaacctgggaggaggaggttttggtgagccgagattgcaccattgcactccagcctgggcaacaacagcaaaactctgtctcaaaaaaaaaaaaaattcaaactgtggggtaactgaatagtttttaatccctcttcctcagataaagatgccacgaaagaaagaaaaggtaaaaataagatgtcttacttaagattaggaaaataaggctgtaataatttcaaaaactaagtataaattaatggataaaaatattgggactgatgcccatggaagataaaagctatactgggtagtctctagtcttcatgacagatattcacagatggggaagactaccccattttccaggcttcccaaaactaacctgtgataattagacattcattgtgatccagcacctcagtgaagagccgtgaaataatcaactcaggattgattaaaaagcggatttcttcttgcacaagtcctgcactggttacaccacctccaacaaaatgatttgcaaaatccacctgttggggaaatgtgacattaaataatggtcaaaaatacctacacatatgatcaagaagcacatagtctctaagctctcatcttttcctctcccatgaaaatcaatccccaaataagtaatcttcccaggaagggcagattttggttgcttaagctctttccacctcactgcagttaacatctctgcacatttttctggatcccagaaccagagaagcaatctggaaaatggagcttttaggcaaaatattatgaatcatacagactcttgtttataaacctatttgtgtctcatgggccacaaatcaagggaggtctttatctgggaaggtttcaaagtcattctcccccattcactactcaacttccctttatgtatttcacgtgactttaatataattaaacttttcttatgtaatatggtaaccaaacacttgccctaaagaactgaaaagtttagtaatcaactttttgggtaaccttttccaactttattgtaagaataaagagatcgaatttttgtccttctaaattcaaccccaaaccccaaactacatgaacattacaaactactttttaaaaatataactaaggaaaaaaggaagaaagaaaacccagtatagcaacaaagattcaattaaagtaatatttccaattaggttggaaactcttaagctttatgtggagtagtatgatgggatccccaaatgcctactaataaagaagaattacacaatcctccagagaaagcaaactcaacttgctggcattatttccgtttgtccagtgtgtccagcactatgccagcctcatgaagcagtatgtaagaaatagcaaccatcttttccttagtgagactatctgaggagttagatcacacacacacacacacacacacacacaacttgtgtatatacatagtcatacacacaagtaaaataggatttactaaataccatgaggcttatattctttcaaactattttaaaatatacgatttcttaaaacttcagtgttctctaaagcaactgatactaaatgacaatctgaagcctattttacaaaatagtaaaacaatagtatgaatcgtttgatatgtaaaaatatatgtcaaaagacagaaattaatagaaggcgaagcagtcttcttttaccacaggagaacttagaaaatactaaaacataccactgaggagttcttcaattgagctaccagagagaatcatatatttggatttgtgttctggagtactaaaaccaatgctaaaaaaccagagtaactctttagcttaaataggaaaataattttggtgaaaccagtctgttgattagaattagctacctactacatatgaggtctatgggcactgggtgattcatggcttaaactgtccaattcaacaactatttactgagtattgtgctgggaatcactggatacaaagatgaataagatatgtatggttcctggcctcacggcatttgcaatttagatggcagtcagaatgagcataagcagaatgagaagatgattattgaagagcttgttactatgtatttgatactttctaataatacaattaactaaaattggagcatgggaggaagataggaaagctttacaaggggatgtggcagctgacatgcaggctgagggcatagctgcacaaggacacagggcaaaaaaaaaaacaaatgtaaatcactgtatgaggggaatggtaaacagattcattgtgcttgcctgcagtgtagagtaggtggaggcttacagttggtgatgaggtggtctgaggtctagggaatttttactcaatttccctctgaaggttctgggaaagattcaagtaacacctggacctatgttttaggaagataattcaggctagagtttaaagaataaatggaaaactgtaaaactaaaagtaaaaatgctggttaggtgagtactaaatagtttatacaggcactactagggcctcaaacaggaaagtggtaaagtaaaggaaagagaagaaactcggtaaagaaataaaatggactgtacttgagaactaagagactggctgagtgcctaaaagtataatgatattgtgactacaaatgagaaacagatgaggtttaagattggcctaacttaatttttactggaataaggtacataacaaaaataaaaagataagctctatccaacttatgtactacttgataatgatgatgaaatacattcaatgtgtatgttattgtttactctttgaataaaaggcccacatttttaacttgaaaggtgtacacagaaataaagacactaaactcagtatgcctctaaatgccagagtcttttagaaaaccaaagttttactacttaaaaaagttcttaacaataaagaccctctacaacagttgagagacctgttccagtacatgaaaacaagaatgtgaatgcatccttatttttagccagttattttccaagtcactttaaagctactcattcagattactcagcttctgaattataacttgatgaaaagacaggaatgataaagctcctcagagaggttttgttgttgtggccattcagcatcatgtaatttatatgctacacaaggagctctgtagcattgcaatacaatattccccgatctcctgcggagacatggcatgggtagggagaacaattaatagaaagaagcccttacggtattctctaatctaccgaggtctcacatttccatctataatatattccaaggaagtggggaggatctcaaccttaactgttgttaaataattccttgttgaattgtattgtaatgaaaggtcagcattcctgtggtgctaactagcagtaactttgtttagttcatgtgtattaagaatctctcagtttatccaagactttaaagatggaaagaacttcatcaagaggggaatgtgggggaaaaagtgatactaatttgaaccaatatttaagcatattttaagattattttttaaacagaaaaaaggtataggagtaaatgcaaatttaaatatgttttgtttttgtttataagctcaaataaccactgggagaaggtgatttagaataaaacatagtttgtctctttgaagattttaattacaaatatgtccaaataaaaggccatttaaaaaagaatctcagtttcatttaaataataactagacgtaaattttatagtgagcattaagttattcaaacaaatcagtccattttcaggcaactgctttctttagattctgaaccaatataagcaccaaataagaatctaagaagaaaaataaactattatcagtataaatgagatggtatacaagcttctttcaaagaaaactcagtttacaatgctcttataaatgggataagaacacaaaacactaacattagtgaattttaaagaagcattataaatcaaaagattaggttagatattactatattttaaacacggggcttttgttaacccccttctccaaaaatactttttaaaggtaaaggcggtaacagattattaacaaagattgagaagtggaccagaattacctgcttttaacagggaaaagacatagcaaacagctagctcacgtgcgtgaaactgttacatatgagagagaggcctttcttatcaatcagttttagacgtctgccccctcaacctaaacaaagctgttggtggcagaaaaacatctccatctggtcatcaactggggcagagcaagaagagcctttaaggaaaaagaataaaaatgcctggtgacagtctgtcaagactataccctgggaacttcctccactgtcaacctactatcaatgtctgaaccaagaggctgatgctgtccagatcttgggattttctgtcaaaggctttttagagaagcacatataagaaacagagagtatacactggcaaatcacaacattaccaaggctgtcaaagtgatctgtttggtgtttttcttcattctgctatcatgcttctttgcattaaatcagtttaggagacaaataaacagtttttcaaatttcttttgctgtcagaagcttgacaagaaaaagtcctaaccatacacagacactactaagattcacctacctgtagcatgcctcggccattttcttctatggtaccttcgtaagtgacatgcaatcgtgtcaagggtttttcacatctacaatataaaaagacattcccttatttattattttaatgacaagttgttcactgcggacaaaagtgaaaatataggtaactattcaaaaaccgaaaccaccccaaatctcgaaagtcagaaacagatgcctactgttaacattcttggtattgatcctcctttattcaaacatgtaaatatacatatttaaattaaaattggataacatagtttgaaacctgattttcctctaaataatatgaaagtttttcttctttaaaacagttgaaaaacattacaaaatattaaaaaaaattaagatctatgaaattttgttatggctagagttggcaatctgaggaaaaatgtagaaaaatttggcaataaatcatatatgattctcttctggcttccattttctattttcactgtttcataaccgtgtgtgtgtgtgtgtgtgtgtgtgtgtgtgtgtgtgtgtgtgtcttgatgaaaatacctgccacagaaattctgaacaatggtatttttctattaataaggttaacagataaacttagtacctgtaatttagaaggcataattattttctttccctttcaaccatggccactgaggtatttacttgacttatgttatattaacaacaaattccattgtattaaaagtatttgttaacattatttgccttattagatatttttcccctgatcacttactgaataaaaaatataaatgaatgaaacagaggagatccaaagttctaactcacataagagtgcccataatcttttttgggagggaggagatgattatatttttagaaaatagtctaggaggttagctggaaaagtactgagaattgtttgattccttcctggtttcaatgagtttaaatacatttctggcaaaactccagcccaacaggctgatagctttaactcagaaggtaattctgcacaggttctgtctaagagccttatttgtattaactcattgaatcctctcaacaaccctattactatctccttttatagacggggaaacaaagcacagaacatctaagtaagctaaccaagactagtgaaataaagcagcagagatgtgaaactaggtagactcactcaagctctgaatcagtatgctacacttttagaaaaattactttcccagtctcttgtagaaaacagtacggtaagtttgatatatttttttaacttcctttttttggtcctactttcctagccattttattcagaggaagacccctgtaagcatactactaaaaagataaagaagcataatctaaaaatctctgggctgtcagtcaggacttcagaatgggaattccatctgttgtcaactattctccatgactgaagctagaaactttatagtatagctcttaataaaatcacgaaattgctagaaactttttcttggttttgttttgaagcattttctaacttcccagtaggtcatcctctacacccccgccccaggagtcagagacgtaggtgattctggctctctgtgattaagcctggctaaagtatttgctgataatcaaagggttaactataacatgccagaaacatggaattcaggaaagcctctaagttcctggacccatttagccccttacgcttgggaacaccaacaatccttatcttttcttcattctccctctttaagtgaatgcatgtttctggttctgtggagtctgggagactggttttaattatattctccaactcacttataaagcaactaaaacaaaaaagagatcaatgaaataaaaataagtcaaattctgcctatcaaaattaaggggacaatcttcgtctcacttagaggcaaagttactgtgtctcattgacacagcagccttgccagtctctgcattttgacctgtcccttctctcccacatggtggtatacaaatgggtgttctttcacattagtgccaaatgaatatcagatgcaaagtagagatcctggatgacttaaaaataagccctcagattgatctataaaatctacaccaaagtaacaggaacaaaacatatgcattcctattagagattaatagaagagtgaagaaaaacaatcctctgcaccatagagatgacacagcagaatggtacttttaattccaggtactatattttaagagggcccaatgaatgggagtatgttaagagcagagataaagggtttagaatccatattacatgtgaaatagaagaaacgaatcagtttagtatgaacttgtatgcactgttagagagggaagtaggttaagaagccattaagatacatgaaggagggtcaaatgttaaagaaaactagaaattcagatttatttatgtagctccagaaggaagaaccaggaatggtggagaatgaatgtagaaaacatttttagtgaatgaaagcatgagatgataacacaagcagccaccaatggaacaaactgatacgaaacagcggatctgccatcactgaagctatccagtcttctgtctgttgcaggtattacagagctgatcaagagttttagcaggcggctggggttcctttcagatctaacatgccatgatgccaaaatgctgtacatgttctcatctttttctggctcatttttttttctctcttcaggtcgcttaaccttttatctacttccctctattaataatcatctaaaccacgcactcagtcttctgaagtaaatttctttatctttcacttcacaaataaacatctttgatggatgaaaacactgcaggaaagccacctaagcagatatgacttctcaagttaacgtttttttaagtgatttccattcatcactaattccaaacaaaacaattacaaactatcataaaattattagaaagtgaaaatgggaggcattggttaaatatgtatttagtatgcttcatcatgtcctcaaacatatttaaaaagttaatctacacttctttaagtgtcctgggggacttgctttagattaagaaatatgttaactatttcaggacccttctttaagtatattgggagacttgctttagattaagaaatatgttaactatttcaggacactaaggactttacaaatctgaattagctcatattggctgctatctcctcaatattttctgataaataagaaacaaacagtaaatagcaacttccacaaaatctaccagtagtacacaagggcagccaaacttcaaaattcttgccactcgacgaactctagatggttactgtttactaaaatgtaaataataaaaagacttttctcaatcttgtcctccagaaagaaaagccataaagttcaaacactaaccaaaaaaaaagggtaaggagaaacatttaaatattggtgttccttttattagtgtcttcacatacaacacttctcaattttaaacaggactttgtttcagaagacaaaaccaagacaaaatggtagaaatcaaagggttatagactttgatttaaaaggcataaccttttcaaacatgagagctatcaatgaatcatttatgagaagaaattccctggcactaggataaatagaggttggaaaaccatctttctaggtgctataaaatagaatcctctcatggtgcaagagtccttctatttctagggggtctaggattatttttattattgttgttacctttcccattctggaaaatcttcaagactctgtcttgtaaatgtcaccaacccagtaggttctacagaagcaataaaagaaaaacatacccaaaataagtttcaattttgaaaagattatacacacacacacacacacacacacacacacacatacacacacacactcggtaaaagaataggtctaacattggctataaaactaaccaggaaatacaaagcctagcattggaaaataacagaatattgattgaaaataatatccttacagtagaaactccttctataaaataataagacttcactaaacgaaactatacaaataacagcacaacagtaggatttgagtgctggtatttttggtaaagtttttgaagctgaatacacttttttttaaaaaaaaaagagcattgaaaaaaaggatgtataactggtacagctaatgcaataaagacaaaattgaattcaaatttgtagactcctttacaaagaaaggacttaaccctacattcaaagactggagaataaatacacatttatgtactatatggtaaagtgaaatgtcacagatttaaaaaggaaatcatttgcacatcctctggagttagtacagctaagtctcaggcttaaatagtgggcaatcactctacttgttagtagcagtcgtagccagaggagaaattactggttctaagagtttacagaacaaagatgacatatttttcaaggagcaataaatttgggaggatctaaatgaagtactattaatgtagtcaataattttagaggatgagatccttttctagtcagatttatttatttattttttcaagctagtagcaaaagaaacaaataaatcagctggccagaagtaatttgtctgattcaaatcaaagaacaaactaaaaaggccatgccgtttctgttttcttgaatacaaaaaagctcttaaggaaagagagagatgtcaggaactattagtgatgacagtgtataacccagtgaaagcctggccatcatttcattcctgtgcacaattccacatttccttgttctcagtcaaaagcaggaaccactcaaaaaccatatggagcagttgcagtagaaaacaaatttttttgttaagatgggtcttacgtcttttagatacctaactttaagataaatggataacatatttaaaactcacaagtaagtggtcaaacaactcaaacactagtgaagcaattccatgaatataatagaaaacatctctcttgtcattcggtaacttagcagagaagaacatcaaatgtccttaatatatactaagagatgctaaaagaaattcataaacactgctggcaaagcaagaaaaggcagaagaacatggtttcttagattaacaaaaatgccttgagagcacgtctgttagcgttttttcgtaacaaggcaactttcatctcagaataggatactttgattaatcaaatacttcccatcataaaatcacaatatatactatatacaggtcataaattttcaaaaacctgatctataagacactttatctaaaactatatagaaagtaatttaattcagaaggctttttaaaatacttcagtctcaagatcttcatcagatataaaatacacatgtttaacaacactgaaaagttggtcctgatggaattctagtttatcaattctaaaaggcatgttttttcacatgttacatttctgaaactggaatacatcttttataatggaggtatcttaccataggtgtagactagaggtgaattttcccagagaagatgtgcatctgcttctgctgtcgtctgggaacactatcagcctgataccatctgaattaatcctttgtggcaggcctttgtggaccacactggtggtaaggctgcacactcaaagcttagggcttgtggttcaaattctcagagaaatgtttttttcctttctctatttagtgtcaaggttgagacttgcacgtttctttatggtccctttcctggaaggtcaagttaatttctcatttatccttaggtgtaccagccttgtgggtcatgtctcctactaaactccctgtcctgagtgttttttccttcttagaggtatataatataagagcatttttaaaaagtcatctatgacatctcagattcgatgaaatatggtaccttaaataagcttctgaagtctattgagtaggctccagaacttctacacaaccactcattatactgcaacctcttttattctctttagtatttcctcttcaaaccattagctttacacactgaagaccaagagcaatgttgtactgtatttctacaaagaacttaattaacatgtacagtgaaaaagtcagaaaataaaatgtctagttataatttatttcttcaaattcccaatacttataatggcatatacatttccagctgaaaaaacaaactttaagctttttcctcaaagtatctgaaatcctaaaatttagaaagccaagttagtttttagagaagacatacatgatttgactcccaggacaaaaaagtaaactctgtactacttagttataataattctacttaaaacggcaactcaaagtactgtaaaaacaaaacaaaaaaaaacaatagtaataattctaattagacctagaatggccaaaaaaagcagtcatttatttatttttttagacagagtcttgctctgtcgcccaggctagagtgcagtggcacaatctcagctcactgcaacctccacctcctgggttcaagtgattcttgtgcctcaacctcccgagtagctgggattacactctcccgccaccgcgcctggctaatttttgtattttttagtagaaatggggtttcaccatcttggccacgctggtctggaactcctgacctcgtgatccacccaccttggcctcccaaagtgctgggattacaggcgtgagccaccgtgcctcgccttacgtagtcatctttttaacaagtcattacaaattctaatttgattttgtgtctcataggtccaaatgattctgcattttaatatttcattcagtacagggcacaaaactgaaattcaataagctatgaggtaattccatatcagagaagcatgtaattttcccttaaatatcaaaatcctgataattgatttcattctaaaaatttaacaatgtccaatagcaatacattcaagggggaagatgccaagcacattgtaatgcaagagtaaaagaaggatatgagaaaaatgaccttaaaatgattcaaagacatattttaagacaatcctatgacccagaactgaaaaaaagccatttcacttgaccaggttgaccttacctacttagcacaaaggaacttttgaggtgttctggtttacatccacttgtaggaaaggctacccattgataatagcttacatttattaagcatgtatcttcttgtttaatatctataactaccctgtaaggtaatggccgttattatattatttcataggtgataaaactgaagcttagaggtgtcaagaaacttgaccatggtcattcagcttctgagataagagtggcaataccaatctattatcagctggtcattaccagtatttgttggacatttactattactgtgttagctgctatcagtttttggggaagcaagaatgttaaggttcaatagaggaagatggagatataaaactcagtacaaaacagttttataagaactccacaaagggcttaggggggcacaaaagagaggaatgggtagaaaagcaatgcgttagttgacttatgcaaataaactagtgaatacttctttaaataaagagcatccaaaatttatttcctggtcaatatactttctctggtttttattcatgaaaatcttttgatgtatattacagatttcagagaatatgggtccgatttcagagtatgtaaaccccgccccccctacatttagcacacgtttatgcttatacacaacataagcataaaatctaggttatattgtcgcatcattactagtgtttcaatgtggttgggacaggaaggtttacgttaaacacaaaatgttcctcacatgtcacttgacttgaactgttcccatcagcaagaaaaattacagtaagaatgaaaggaatttacttttctctgtgactcttctaaagtagcagaagagcgttttaagtttctccggtttccttgatgaacgtccctcaaacaatctaaaagagataaaaaataaaagagaatggaagataagttaaaatgccttaatgattcacaaaactacatccatattgctaccaagtaatacaaagaaataattcttccagaagacaattctgtaatgataagaactggaaaattggtttagattcaaatggcatctggaaagaactgaaaccaactagaaccagacttcttcaaagctgctcaaatcagacatcatttactaccaaccacatttctccaacctatcttccaccacagagaaggcaccatccagccctcccagtcaactggggtcagtcagtcagtgcacagctactttctcaatggctaataacatttataattcataatgttactacgtagtttgataagtaacaaaaacggtatcaaaaaaaatccttatctgagtgtttgtgaggaaatgagagtggaggggaatgggggtagggacacaggcaggtataacaagatatcagggctcaacaatccttgttaaacaactagattcttttatggactgaatgtttgtgacctctcaaaatttatatgttgaatccttaatccctaatatagctaaatttggagatagggcctgtgagcaggtagtaacagttaaatgaggtcataggggtgggactctaatctgatagaactggtgtcattttaaaaagcaaggtgagactacagtactctccctctgccatgtgaggacaagatgccagccaacctataagccaggaagaaagccctcatcaggaaccaaagcagcagcaccctgatctgcagcttctagcctccagaaccatgagaaaataaatttctgttgtctaagccacccagttctatggtattttattatggcagcccaagctgactaatagagatcctttgcatggtaaccacaacagtgcctaccctgtgtcatctagttttcagcaacccggacttggattacttaattccgttttctttgaaatgatgtggcattgttattggtaacatacaattcagtttattctgaggaaagaaaagcagggctttaaaagcattatgacctgagtaagtagctcactgaaagatttctaacacaaaagcatgcttttgagcataagatctagctttccaaaggcatttaaaaattatagagactcagtggctatgaatgatgaggtactcttcatctgcctctagtcatgtgctctgactttaaaaccagagacccttcaagtaaagtccatgttaataagtgctgaaatgggtaattatttttcatgattacaacagcaagcttatgtaactacgctgagagggaaaagttaattccatgagaaaatcctattgagcgactgaaataaattaggaaaaggaaaggaaatgcacatttcaaatggttccgttttcaatgatctgaaatctgtattcagggtcaatttctggaaaaacaatttatatgaatatttatttcctaaaaagaatactaatgtatgctagtattttaaccaaatctaaaatcagatctctttttaaaaatagtttaagacagcctgtgtgataatttttatttaaagaacctatctttctaaaatatttaatacacatactcttataatccagttgccagctgaaagaaaggctctttgagggtgcaggtttcagcatggcttcttctagaatagagtttatttaagtcaaaatgaagaagccacatggcagtttaattaaacatcctatatcaataaatatgatttactaaatgaatacctaaggctccactgcaaaatctctttctaggctcactatgcactagaggaaagcaatatgaatacaaaagtagccaccaccttttcctagagatgaattgatgtactatacaattcaattaaaggataaaagttcttcttcaatagaactattgcatagtgaggagaaaatggctgttgctcttaagaaataattctctaaaacataggaaaagtgtccctagcttccatatgcggtcatctgtataaaatcacataaaaggtcacatacttcacaaccatgatgacaaattattaactttaggagcctcgtgagactgcagatttattatcctggcgagacagactttcctggaagattttatggctgttattatcacccactacaaatgaacaccactgtttattttgtaggtacaaatcttaaaggtacaaatcaagcagaatctcaatgtactctgtttattcactgctccaatcctaacttcaaatcactgtgtaaccaaatacactttcccatcttcctgatagagcagggggaagtgggggaagtgtcgtggtgggtgtcgggggtaagaagtggagataaagtcagaggagatgaagcaggtttaaaatccttgtgacaattctcagacttggctgttgtgaaattttaaagttgtatgcacagccactcaaataaaatgaattatcctgatatggaagcaagtaaaaataacataaatagacaggcaaacagcatgaatgaaagtcatcccaggagtgatatacaatctgagggacagcttttgggaatgaggaggaaaacaaaaggactgaggctggagcccaagaaacgggtgaagggggagaagaaagatggggcagggaagatagagagaagagaaaggctgatagaaatggggttagagaaagagagcatgagagacagacacacagagagaaagacatacacaaacaggctcagagaaagtgaggccttctcataatcattaagcatcattcccccgcccccactttttttgtaaacttcccaacacctttcttttttaatttagatttttcaagtcctgggtatgtatatttgaaggcatattttaagtcagcagtgtgcacacaaaccaggccacaataactcctctacatgtagggaggacatttgggcatttaattgaaagataattacagattattaaagaaatcaaacacaaaaagccagtcaggaaatcttactttgttctaaacaaaactgttggtattttcaaagacagacatcagtcaaaggtcagacacttattagctggtgtttttctttgcatacttataaggagaaacagagttgaataaaatctttccctgaatggaatactgataacattactggaattttattctaggtatatccatccccacccccaccatgacccactatgccatttcaagttaagtaataatcccattagtatacagtaaatcaaacccaaagcactacaacctccattttaaaatacgagcaagtgatagtccggaacccagccagaaagtcattcctggctcttctgtgaggcactctgccatatggccccagcagcattttcaatacagggaagaggcagatgtaaaaacctcctgggctgaccactgctgagacccacaatttatctctgaccatctagtttccatgcaaactcagaagcatcgatgctaatcacattggaagcctttatatgaatgtttaggacctgaaaggcaagcagggaaaaaggtcaggggtatttaccataactaagcagggcttaaagaacacagcaataaataaaaaagggaagacatattcaatttattgacttcagcctcccaccacatactcttaccatttttcttattcaactagctagccatacctctcttttgagattaaatacactctcacacacacaactccccactgctagaaactataatcataagtagaaactatgcataaaaggaaataacacaataaaatgctacataatcagcttaacaaatggctcatcagattacgtactggatctttcagaagccacataaaagtggggggactttcagttgtttggcatttccggagcactcagagcattttgctcatgacaggctttgagatataataaaagaacactgagtttgagtagaagacagtgatcaagttccagttgtgctaacaattcatttattctccctgaaccttatcagtagagaggcttccctacctagaaaattccatagacagaatcaaagcaagccatcaaaagacagtatcaatggtgatgtacagttgttgttcctattatttgctagcttaggctcattaaaacacacaccatctcacagtgaaaggcaagtgcagacatcctggctgcttaggattctctacaacattgtggagactaacactaggttacctgccttaattcatttttcatgttctgctatccaaaagaacatccatcacctaggaagacaagaatatgcctgatttcaaatcttcaacggaactacttaaactcttatttggtgagaatgctatttgctgcaagcttaaatccgtcacggtcactctggacttaaaaatggctttaattcatttaatagatcaataattatttctaaaaatagttctaatttttgactagtcatgaggtaagaattattaattcagttcattcaaagggagactgtgtagcagaatggttaagggacacagcttctcaaaggagactacatcctgcgtttgaatctcaagtctactagttactgtgttaacttggtgaagtaacctcccctctctaaacttccacctcattttaaaaatgagtgtaacaacaattcctaatcaatattctaattcatatggttaatgtgacaagtaaatgaatttcagataatgctgagtaagctaaggtacttgcgctaaaataaggcattacataatgcccaggccaaaaaaatcaacattcatttacataaagcagttgcattgttctaattaatattcccttcatttaaaaaaatggcccagccttgattcccatcaagcccaacatgctgactttcagcgctaaccagctcagtcttcaggataaatgaccatgtacaatgaaaaagataaacctgccatcgccaagaagccccaggcttccccactcagaaggttggctgaaaaacaaaggtcttttaaaattaaaatatataataaaattggccgggtgcggtggctgatgcctgtaatcccagcactttgggaggccaaggctggtggatcacgagttcaggagactgaggccatcctggctaacacagtgaaatcctgtctctaataaaaacacaaaaaattagccgggcgtggtggtgggtgcctgtagtcccagctactagggaggctgaggcaggagaatggtgtgaacccgggaggtggagcttgcagtgagccgagatggcgccactgcactccagcctgggcgacagagcgagactctgtcccaaaaaaaacaaaaacaaaaacaaaaaagatatatatatgaatgtaaattctggtaattggttacaggaaattggaagtcaccaaagccaagccttcccaagacatcttgacctctgcctgtcagccatccagcagcgatgggtctttgctccctacagaactctgtggattctatttcttccataagaaataaaatgctatatgctgaataagtaaaatagggtgaagtagacacaatgacaatgtgtctatggaggagtaattggaaagaagctatccacactagcttttttggaaaagcctcaaaaaatctgtgaaattccaccctcaaaatcaaattacaaaaattgtccactcttattaactttgtgttcagcttgatttctgacaactgacttgttcttccctgaactattttttcttctgcacgtaaaagtaatatatgggctgggcgcagtggctcacgcctgtgaaacaggttttttatataactgcaattgcagattccaatgctctgtgttttctctcaattctaccccaattactaacgaaatcagaagtaaaagctatgtttgattatatgtggcttaaaaataaaacatctcgtaattcctaagactaagacataatatgaaaagtaaaagacaagagactgagaacaaagggtctaaattatagtcttagcactctgccactaaccagctccattactcaaaacaagtcacttaattctcaaatatttcatctgtaaaatttcttttcattcattcaagaagcatttattgaaggcctacaatgcatgagactttgtgaaaataacaaagacagttaagatccctgtcccactgaaatgattaaataagcaattatgaagtagtctaggtagtacagtaggaaaagtaggggacagtaaaggcacacatctggctgtacaaacctaaggagtaccttggatgcctctctctgcccatctaccaatcctgtccatcaccatcactctggctaccccttcaaatgtctccacacctctgtcccctcccctacactatcccagctaccatcctctttcccggtgcattgcagtagcctctccaattgggtaaactcatgtactctggcccctctctgcttgattcccacattacagccaaaataaacttttgaaaatgtaaatctgaacacatgtgctagtctccctctacccacatatctaatcctccaatgacttcctgttgttttcagatggcctagtgaggcacagcatggtccagcctccagctacttctgtagcctctaccatctccatgctccttctcactctctgtgctgcaaccacactgtcttctctcagtctctggacatgtcaggtccttcttgcaacagtgactttacacatacttttcccctgcctagaatgcaaccacctctccttctccttggcaaaactcttattcacccttttgtacttaattcaaaagttgcgctgggcatggtgacatgtacctgtagtcctagttactttagagactgaggtgggaggatctcttgagcccaggaatttgagaccagcctgggcaacataatgagacccagtctcaaaacaacaacagcaagaaaagttatttccttgaggaaagtttcctttattaaattatatctttctttaataaaacgtcatggtgctgtgcacctctccagaggtacacacaggctagcataggaacctggagtagcaaacctatcctagcagaatctgagacaccagaaaaactgatacgtgaactgagtactggaggaggaataaaagccacgtggaaaagagaagggcatctgtgacgtgaggtttgaaaatgagacaatactacataacagtaagaactcagaaactggcttctcctttctctgtaaccttatggcacttaatacactgtggggaatattgcagttgctcattgtacatttgaactaaacattgactaaataccagtatctaaaaacaaacttacctactgtacaaacttgaaaaatagattaaaaatatgccccttgcaactaatatttatgtaaccaaggagcatattatatattaaaaaaaaactatcctgtttgctaacactaggattttaaagaaattttcttagataacattatttttcattctttgctgcccctttcttagtgttgatagtagagggtaaccatatataataacaaattatcatcaatattttaatgtttgaaggtcataaaaatataacccaagaattatgacagtctaagagcagcttatattcaagtcatctgctatactttcatctgctaaacacacaataaatgcaccgaaatgtctagtttttaagtttaattaaaaatttacattaggaactaaccagctgaattctagaattcttctcatcttaagagagtaaaacattctccaattttaaaaggctaaaaaatatggtcttcggggctgacactctgatattggagagaattgtgaattcatttctctgctgccatgtggagttataaggaatgctgcccacataaagtaagttgcattagaaacaatgacactctagcagcaatgagcacacctatcacctagatgttggtctctaaataccgttgtacaataaaagagaccaggaatccttgagaaaatggttcattccaggattgaggcatggaaaatgtaagatgaatctggaacaatgtatgattccagaatgaaagttaatgctcaaaaaaaggatagggcttatcaaaagaacataggagtcaacctaaaggagccctaatggccaaagctagaataattaaagcagtaaaataaataatactgtttaatttaaactgacacaacaaaataaatatccatgagtccattctgatattttaaaaacgggggaaaagggatagctcttccttacaatggaatttcaattagcaaatgtagaagagggaagcagaaaattcacaacaggcaaacactatggtaataatcattgcagacaagatgcaccaatggatgccaaaattagtagggataaatgtgaggcaaaacaacatttgcatagtgttttatcttttggaaaatatttattaatcacaaaaggaaatatggtaactttatagtggaaaaagtcagcagacactacctttgccaactgatcaccagtaataagaagtatcatgatcccactgatatggtgcactgagaaggacacaggatcatttctgtggtattctcccaaaaatgcatgacctcattccaatcctgaaaaaacatcagccaaacccagactgagaatattctccaaaataactgtgatgagtactcttcaaaactgtcaagatcacgaaagaaaagaaaaaacaaggaacatgttggaggagactaggtaattaaatgtaactgggatgctgggtaggatcctggaacagaaaaaggatactagaaaaactggtagaatcagactgggtgcagtggctcacacctgtaatcccagcactttgggagatagaagcaggcagatcacctggggtcaggagttcgacaccagcctggccaacatggtgaaaccccgtctctactaaaaatacaaaaattagccaggtgtggtggcatgcacctgtaagcccagctactcaggaggctgagaaaggagaatcgcttgaacccgggaggtggaggtttcagttggccaagattgcgccactgcactccagcctgggcaacagagtgaagctccgtcttaaaattaaaaaaaaaaaaaaaaaaaaaaaagtgatgctactgatcattctacttcagagacaaaagcagtatggcaaacaaaagtgggttttgtttgtgtatccgctctatgactttatctcctactctgcatactgccctaccctcagaggcaggctctgggtgaccagaggcagtgaagggcattacacacagcctgctgggaaaggggcacagattatagcaattttctcaagtctcacactgaaatcagggaagaaaactcacatattctattcatgggtcctataaagataattctcaagtgaagaaagaaacagaggtggggatatgggagtagtgagtaggagggaagaacaaacattaatttgccaagaagattctttaaaatatttttgtttgtgtagaagatagagaaagtagtcacctgggaaaatggctggaatctaaaactttatcaataccttcacactgtattaatttagtcgagcagtttgaacattcttttgtttttcttttaaaaatattacactgataaattaaccatgtctataaagggtcaaaatcacctttcacttttcatcaaaacaattacacttttcaagtctcataagacagctcatgactttagactctcattttataagacctttgtagaaaggaggacttttcctctacctttcacagtatttcagcattaaggaatataagcacaacaaaagttctcgtgaataatcaaactgaagaggcatgtggagtccagagaactggggaatcatctgagaggacagaaagaacatgggccctggagtaagacaggcctgaaataaaatctcagttctgtgacttactagctcctggatcctaatcaagttcttttaacctcaatgaactttaatcaccttgcctgcaaaatggtgaaaatgtcacttaagtactgtaaaaattaaataagacaactgcatataaaatgcttggcctatggaattcattcaagaaatattattagttccttccacctttgtctttttcattgttaaagaggtgttttctgaaaacataccgattgaagttaatgtctgggtaactagaatactccgatttcatctgagcatttcatcgtggaaatgtgcagaagaaagcattagctaaaagactggcaatctgttcctgcgacattgtgatggaatgattcatcttctgtttcaggagtggtattggctgataaaagaaacaaaaaaatacagacgagaagagcaataattagtttagcaatttcaaaagcagaggcaccaaattgcatttgctaaattaaggcagaaataatttcaggccattcttgaatccttaaatcagcaatattgtaaaagtcaagggctgtttatcagggatgattcagaaaatgcacttatttgacaaactgcagatttctaatcaataataatgatagtgaagagaatataaaacattacttattagtgaaaaacaagattgcttcagcaagtaaataaaaacacattgcccatgtaatgaaaaattagaacaaaagatgaaacaaaaatatataacattgtttaagctaaattttgttcttatttatattaaaaattattggctagaataatctttcttagtcctcaataaaatgatctaagataattcaacaaataagtcttaaccctccctcttattccaaattacacttcatactcacaatttctttataagaatcaaatctaacttcattaaagctattaatagaacatgtaaaaaccaccatacggacatgtataagttgtaaaaagataagacatttcttacataaccaaacattccaagtcatggaagatgtaagacatttttccttcaaatcttttatgtctaaaatgtcttctagttatgccaccaaattcacttaccttttatttcagtataatccacacgacctgagtattgtgttcagtgggttttattctgtttgtaaaccaaaaataaagttccaagccccccaaccaactgaatgaacccctcctctcgaccaaggggattccaaagttaacctgaaacactagtccacaccatgataggaagtgtgggtctgacacgcctcattatatgctcctcactttagaattcagcacaagtgaccagcattaacaagaaaacagagaccttaaaactgatgaaacaaatctttttataataataagactcaactccagcctgactcgagtatagcatcacatgacagatagcataccttgaaagaattgaagtattttaccccaaaatatatttctttgacatattttgaaatagccctgcaaagctgtctgttgggaaaatgtacgttctgtaaagaatctctattcctttccaggtgagaattaagaaagggtgtggtacctttttagatctgataaaagctctgaagcctgttacaaggtttcatccacatgataaaaccttggtctccacaaacccttatcttaacccagatattcctttctattgattccaggtctttgactcttccaaccaattgccaatcagaaaatctttgaatctacctaagacctgtaagccccccttacatgtattgattgatgtcttatgtctccctaaaatgtataaagccaagcctgaccatcttgggcacatgttctcagatctcctggggctgtgttacaggccactggttactcccatttggctcaaaataaatctcttcaaatattttacagagtttgactctttttgttaacatattttaaatgttaaactatgtttttaaagacatgctgataaaatcaaagaccaactaccagtttatccttctgctgttaagtttcaaaatgctcccacagaatatttagagatgcatttcattctccccttcagtaagacccagaactaagagtttcgggtaactgcactcatctcaaaatggcatgcctagagcaaactgtcctgatcatacctcaggagtggacacccagaatgaacctgaggaaagggcaggcaagacaaaccaaaactgcggtgctgaataatgaatgcttttctaagtacagaagtacacaccactgctagaataagagtttgccagaaaaaagaacagattaaacttgtaattcaactatttctcttggaaaaattcaaaggtaaacaaataagcaaaaggtaaagaatgtattttcactatgtttacaaaattctctccccttcaggtcttagcaatcaccatttctgagaaaaatagagagctcatattgatctccattttccatcctgtgcatttgttcacaaccaagcaacgagtttagaaaaggtgacagtgcatcaatggcttcaagcaaagtgctgcttggttttaggaagaaatgagtttttaactaccatttaccaagttattcagaaaaatgattttaaaaattaatggtaaatatttcaggcttaatggacttcaaacacaaacatttcttgtctcccaaataaacaaatagtataattttaaatagagttaatgatttctcctctcttggtgaggagaaatgcctaaaaactcattatttggagaaatcaggagatgtaaatcttactgtcaagcaatcggctcaacaaaataagaggctggttactgtgaaccaagatatttcaaaaagttcctgaccaaatttgtttcctttaattttattttgataaatctaaaatttaccctttagatttggcctagagtacttcaatgtgataaattattaaacaccaacatatacaatttaacttgccacaagacgtattttgatctcaaataaaaatcttaactttcacagcagagattgacttttcaatagggggcaaagcacagaatttccatgcctacccgttgatatgctaatggagaagaaagtcactgagagaagccaggacaaaaagctgaggactcaggggtctgattttggttccaagggacttgttatagcttacaaagtcagatacctttgaacaaaaatttctcattaaataaaatatggaaactctcatatgcacgaggggaagaggattaaatggcccacacccaaaggctacctactacctattattgattatgaactacatattgaattcaaaaagcatataattaagcaccatgcaaaccagggacacaaagaggatctccctttaaggagactataatccagtggcaagagatatataatgacaagaattacaaaacaatgatttgagtgcttcaagagggatgaaccttgcctgggaggcagggaaggcttcacaggggaagtaacagacaggcatacctaggaggtagggagagaatttactaagtaaggagagaaaggaaaaagaacaaacatggaatatgatcaagcaaataacttccaacagaaacaagaagatatgttttaaaatatatttcccctgcccaatagtaaaacttatttcaggcacaatgcattactgaggtgaaattaaagttacataaaattgaaaacatcacactggaaaacatttcatgggtctcaactgaaggtggcatagtccaggaaggcatttggacatgtatgggttgttttctggttgccccagtgaccctatttgtggtttttggggtgtcctaatgacatattgcaatgcatgggaccattatacacattcagaaattgttccacccaaatgtccatagggcccctgtggagtaaaatgctagcagaaccctggctagcagccatgcagcaagaggcgttggccctagaaataaaagacaaaggcaaattcaagcacggttgtgagaaacacaggaataaaattatgaacaaaacaaaccctgtggaggtttgaaaatacgttcacaaattctttgatgctcctctctttaagaggtggagtcttgggcacggtggctcatgcctgtaatttcagcaccatgggaggcaaaggcgggcggatcacatgaggtcaggagttcgagaccagcctggccaaaatggtgaaactccgtctctgctaaaaatacaaaaaaattagccgagtgtagtggcacatgcctgtagtctcggctactcaggaggctgaggcaggaaaatcacttgaacccaggaggcagaggttgcagtgagccaagatcatgccactgcattccagcctgggggacaaggatgaaattcagtctcaaaaaaaaaaaaaaaaaaaaaaaacaggtggtctaatacccctccccctgggtactggctagcttccaatgaacagaaaaacagcagaagtgatgctaggtaccttgagaaaaataggtcatagaagacactgcagcttccttgctctctcccttggattgcttgctctggggaagttagctattatgtcataaggacaatcaatcagcctatagagagacccatgtcagggcgttctgccaacagctctgtaagtaagccaacttagaggtgtgtccttcagccccaggcaagccttcagatgactgaaaccctggctgacatcctcaccgcaaccacgagagaaatcctgatccacaaccactcagtcagctaatctgctcccaaagtcaacagaagctgtgagataatacatgtttattgttttaagccattaattttgacataatttgttatgtagcaatatataattaatgtactccaaacaaaataaaatacaggattctttatttttaaaagttaaggctggcacagtggctcacacctgtaatcccagcactttgggaggccaaggcatcatctgaggtcaggagtttgagacgagcctggcaaacatgctgaatcctcgtctctactaaaagtacaaaaagtagccaggtgtggtggcgcacgcctgtaatcccagctacttgggaagttgaggcacaagaattgcttgaacccaggaggcagaggttgcagggagctgggatttgtgccattgcactccaaaaaaagaaacttagccgggtatggtggtacatgcctataatcccagctacttgggtggctgaggcaggagaattgcttgaatccaggaggtggaggatgcagtgagccaagattatgccactgcactccagcctgggtgacagagcaagactctgtctcaaaaaaagttaagaaagtatcattaactcatttgttgtagaatttgggggagggtgaggaaggagtgggtcgtattaagccattttgaaaatacgctattccaaatccactagtatgttttgaaataatgaatacttttttaagttagaggttatttaaacaaagagagaaaaaagtcaaagtaaacaagcttcaacagtgtaaacagaagctgaggaatggaatgctgcatttttaatgtccttttgtagtactctctaccctctaaccttttccttaatacagcaaaattactatactctttggcaaaaactgtttcccatttcttctcttctcttctcttcctctctctctctctctctctctgtctctctgtctctctctctctctctgtgaccctggccattcaagtttaagggaaattcaattgtcagtctcagggaagctactgaggaagctacatccactaacctgggtgcaaatatttggcagacagagtgcaattttcaccatatcaggcaagatggactgatataaatgttgagcttctgtttcttcaagtacctgaaaaccaataaaataagttatgtgaataacaataaccagtaaatataataaccaatgaatatgtttgttatgaaattaaattacatatctgcttttcatggaaccccataaagtggcaccctatcagcatcaccaaacacatgtacaaatgcatcaacaggtgtatacaaataaacttacaaattcatttccaaatgtatatttggcattaaggcaattcaccttaatgccctctgaaaaaaatgtaagtatcccaaatatcaaatatccctcacacaacattcacaataaagtaaaaacacttgcaaatggaaaacagtacattctgcccttggttatatcaactagaaactgctagacaccagggactttcttagaagcccccaaggacccatctagtttcaatggtctacaattgaagaaatctccataaaagccacattaattacttcagagcatactctatgggtcaaatctaatctgttgggtaataaacaatgaggtttctgatggtcttagaatttctcttttccagacacccttggaaagtgaaaaccacaattcccatataaaaatttgaagcacaacaaagatgccatgcatggtccatttttgtcttttataaaatttcccctctctataacaccttttaatctaatgtctttctaaacatcagggtatttctttaaaagtactggaaatgacaacactcttaatttagagatactacatatacagtcaggactgaagtaaatactttatctacttgaaatcacattttaactagaagaggcctcagttataatctagtctgagcttgtcactattacagagaaaactgaggccaaggaggttacctgatcatcctacattgaggtcaattaaaaccaaatcagaacaagaacctaagtgttctggtctctatgccacagctcttcctacttccctatgtgaccaatgtttggaatcgatgaagaaacagactcttgacaaaaatcaggaactaagctgaaataaaggtaaaaccatttgtttatctgcagccggacagggtatgtgtgtaaatagaaaaagtaacaaagaatatttgccctgattttgccagaaaattctaacactaagaattttctttacaccaaaactctaaaacccaacctatgtttacttctcttttaaaattaagataatgagtaaacacattcagaatgaacagaaggatatttgtaattcagagagttggaaattcaattagtcataagcatacagaaaattaaacaaaagacaattattaattctggagaaaaagagttgtttaagagaggaaaagcaatcacagcccatatatgaatagtgtttatactatccaactgaaaaaagactactgatgtaattgaaatgaatatgaaaactatagtgagaaaatgcagaggtagaaatgaggtttgcatttatggtagtggagaaagtgagaataagagctaaatcctaatcttctaaagtgggacttgttttaaaaagactttagagtagtcaaatgactgcctctttataatctgcctctttaactctgttaaaaattaaaaaactaaatttttaaaaaatcatatattcatagatgacattctactattttagaggtatgcactaaagatactggcttctctatacctgaaaatatataaaatatattaatgcatttgtttaaaatattcaaactcttcctgtttataatttatctttttttttttttaatagaaacagggtcttgctctgttgcccaggctggagtgctgtggcatgaccatagctcactgtaaccttgaactcctgggctcaaaaaatctcttcctgcctcagcctcccgagcagctaggactatacaggcctttttgctttttaaaactatgtattctgaaataattatagatttacaggatgttacaaaaatactacagaggtacagtatacctctcacccagtttctctcaatggttacatttcacattactataacatactaaaaaccaggaatacctgtacaatgtgtatcattctatgccattttatcacacatacatttctgtaatcgccaccaaaatcaagatgcagaaccattccactgcaataaagatctcatgctacccatttatagtcacactcagcttccttcctctcgctattcctaacacctaacacccactaatttgtttttcagctgaaaaattttgccatgttacctacatggaaacatacaagtcttttgaaattgacattttttacatggcttaatgcccttaaaaggcattcaagttattgcaagtatcaatagttcactcctcctcattactaagtagaattccatggtatgaatataatattatataatattccatggtttgtttagcaatttcacctactgagaggcactttggttgttttcagttttgtactattataaataaagctatctttagtctcaacctatctatattgttgtctgaaatcacttcctataaacagcacagtgtgtcatttttaaaattcactctgcacatctgtcttttaacagatgaatttaggtcatttatgtttaatgtagtctttgatatgttgaaacttaaatctgttatttcattttatttcttttatctgttttcttttcccttcctccttatgggttacttgaacatagtttaaaattccatttttgtttatctaaaatgtttctgactgcatctctttgaatagattttttttaaagtagctgctgaaggactgcattacatataacttaccaacatttactggtgtcaacatttcaccagttccagtaaagtgtagactttaccttcctttaaattcctttacccttctccatttataatcttcaatatttcctctacatacattgataactatactattttacaatatttgaaaacagtgaaaaaagtcaaacataatttacaacactcaaaaaagtttttaaaaagtctattatatttactatatttttactctttgttgttctttcttctttcctgatgttccatgattccttttttttataatttcttttctgtttcaggaaatttctttagacattactttatgttaggtccactgatgtcaagttctgttttccttcacctgagaacactgtggtttcctcttcctttctgaagaatatcttaattggatatggaattctgggttgacaattctttccttagtcctcaaaattttgtgtcacttctttctggtctccatgtttgctgctgagagatccgttgtcattcaaactgtttttctgtataggcattgtgtcatttctctcttgctgctttcaagattttttctttgcctttggttttaagaaatgtaattatagtatgtcttggtatgaatttctttgggtttatcctacttaagttttggtcagcttcttgaatctgtagatttatgacttttgtcaaattttggaagttctcagccattatttctttgaatattttttcagtcccaccctctttcccctccctttctgaccacacaaagacacaaatgttatatctaaactctgggttttgttttttcatctattttctcactgctgttcagactgagtaatttctcttaatttcttccaagttcactgattctttcctctatcatccccattctccattaaacctgtctattccattttaaaaattcagttattatatttttcagttctaaaatttccatttggtttctctggatagtttctttttctttgctgggactttctgtttttttcatttgtttcaagtatgtttataattgctcagccttcttgtgatggctactttaaaataattgtcagacaattcacatctgtattctcctggtgtctattgatgttcatttttcatttcagttgagattttcctgattcttttctggtcatgagggacattttgttgaaatttggatatttggggtattataaatctttagatcttatttaaatcttcagccagagcaggccttctgtgatactgtgccagcaggggaatgggatagctacttcattaccagcaattgagggtaaaaattcatgttccccagtcagcctttagtacccaaagtggaaagtgagagaggtacctcgatagtgctgggttggggtgagagttccagctccccactaggtctttactgataccactttggtgccatgtactctcctagggtcccatagtccctgctggtcagtggtcttctacctttcagagtcttatgtttgttttacatacaaggtcccctgtttttcactgtaattagtgggaaggacagacagaagtgcctattcaaccatgttaaacctaaagacatgaaaccttaagtgtcttaacaagctgacacgtctcctttgggtatccatctttgtcttttaaaactgacatgagtggctgctgcagtgctctgctgacaagctttacaatattgcttatttatctgatgaagcattattgcactgtacttcttcacaactgtcaacactccagacctatgtctaatgctgctttggaaacacaaaaagggaacctaaaaatgtcatttaagaacataagcgactcaactactgtttgagatggaatgcataatctaaaatatcaccatgaccttataacctgtacaatgcaaactgggatgcaagtagggaaaagttatttaagatgtacatcatttcttaacttcaagaaaagcaagagccattggtcaaatcttctataacaattaaagaaaaataaacatacattacttattatgatgataatgatgattataagggaggtaagcatttacatgatggtaaaaaaagaaagttgtattaaattctcccacaagtaaaaccctgccctctactggatagtctgcatagataattacatacagcaagtgttttgatctgtgcgtgtgcgcgtgtgtgtgtagcaactttttattctagtcccacaaattggctgtatatatatgtaatatatattatacatatatttcagtcaaaattgatacaataaatttcaaaattatactgctattttgcctatctcctttccttagattatagatatgttcattcattcgattggctgataaacaaatacctgaggaactattatgtctcaggaattgtgccagaagatgacagaagagtaaacagttaacagacgtggtcactgacctcatgaatctcatggcacaaagccctatcctctccctgtgacccccaatacatcagccctaacctaggagggcagtaataactgcaaccacatcatagtgactgtggacaggctatttttttttcttctctccacaaatagaaacaagctactaaaataaaggaactaaatctgccaaacatcaaaacgttataaatatttaaatatctacaaacatccaaacagaaaagagatatttacttatttcttctttctttgaatatctgattaactacatacatctgttaaatgtgctctaatatttatgaaagacatatttatacatgactaagtaccatacctgacatatggaaagtattaaatattgactactgaactttgaattaataagtgaaatctgtagctcgcaaaatgagaagaccagtgttatttcaataaaagaaaatatttccatagatctttttcaaacagtttagggcaaacagctttaaaaaagtaatcaggccgggcgtggtggctcatgcctgtaatcccagcactttgggaggccaaggcaggcaaatcaccaggtcagcagatcaagaccatcctgtctaacatagtgaaaccctatctttactaaaaatacaaaaaattagccaggcatggtggcacatgcctgtggtcccagttactcgggaggctgaagcaggagaatcgcctgaacctgggaggcagaggttgcagtgagccgagatcgtgccactgcacttccgcctgggcgacagagtgagactttgtctcaaaaataaataaataaataaataaataaaaaataaaaaaaaatcacaaattaatgaatataagaaatagcacaagctgctccgttttctctattggtctaaacctagttagatcctaaaaaaattgtgaaaagttactaacaatcctctttaataaaaaaaaaatgaaatctatatgaaacgtctaggatgtgaaattttagacaatttttcaataagaagtacaccactccaaaagctaaatagcaaagaggatatatcctcataatcctatggtccatatatatatatatatatatatatatatatatatatatatatatatttttttttttttttttttttttttttttgagatagatctcactctgtcacccaggctggagtgcagtggcatgatctcaggtcactgcaacctccacctcccagattcaagcgattctcctgcctcagcctcctgagtagctgagactacaggcacgcatcaccacacctaggtaatttttgtatttttagagatggggttgcgccatgttggccaggctggtctcaaactcctaacctcaggtgatccacctacctcagcctcccaaagtgctgggatgacaggcatgagcctgtaatactgaagatgagtgatggaaacagggaggttcattaccccattttatttttgtgtatgtctgaaatgcttctttaaaaaaaaatttcctggccgggcgtggtggctcacacctgcaatcccagcactttgggaggctgaggtgggtggatcaactatgttcctaatagtaacataaccaatatttatacctaagtttctttttccttttacataggtgcatttatcagtggaaattatgttgctcaatttagtattttttctcaccaaatatgacaaaaaggcattttttacatcactaaaggcaaaatgttttttaaaatgtcatgtattttcactgaagaaaattaatataaacaaaaagaaaagaaatattacccacaagcccactgccaagatatcctcttctcagatataaacagatgcgtatttcctccccaaacttcttctgagaacttaggtgtgtgtgcatataaacacacagttttgtgttaccttaatttttaaaatattatatttttctacaacttgtttttgccttaagagaaagcctaaaaagtctttccgtattatacaatgacaaatgctacacagtattccaaagtagagaagtacaataatttttgtaatcattcccctttgagaaccatttttcccaacgtttttaaaaatttcaaaaatatggtgaagttaaaataactatacactgaatacccaaatactatttggtttctatgattaacattttatatttgcttttgtcatgttgtcatcagtccattcttctgaccacatatcaatgcattttttaatgcgttttgaggtaagttgcaagcattccaccccatcacttcagtttgcatatcagcaactagagttcacgccaggcatggtggctcacccctgtgatcccagcactttaggaggccaagccaagtggatcacttgaggtcaggagttcaagaccagcctgggcaagatgatgaaaccccatctctactaaaaatacaaaaattattttattgtatgaatacacccacaatttgtttattcattctcttgttgatagatacctgggctgtccccaggttttggctattataagtaaaactgctataaacattcttctacaaatctttttgtgtgcatatattttcatatctcataggtaggtatagaaagaaatgaaattaatgggtaatagggtaagtatatgttcagttttctaaaaaacagccagacctttttccaacattgtagtacattttaaactcccaacaacaaagtatgagagttgcaactgctccatatcgctacctacatttgatcttttagtctttctagtgcctgcaggctaatatcttttctagttataactggcatttctccagtgacaaataatatcaagcattttttaatgtgcttattggcaatttgtataccttcctttgtgaaatcctttcaaactcttgctcattttctagtgaggttggctgtctttttatttttcaattgtagttctttatatattctggatacatgtcccttgtcagataaacattttgcaaatatttctccgtcttttaaaatttatttatttctatttatttatgtgagacagggtctcactgtgtcgccaaagctggagtgtcatgatgcaatcacatctcactgcagtcttgacctcccaggcatcaatcctgtcaccctcagcctcccaagtagctgggactataggtgtgtgccaacatgcctggctaatttttgactttttttttttcctttttttttgagatggagtctccctgtgtcgcccaggatggggtgcagtggcgcgatcttggctcactgcaagctccgcctcccaggttcacgccattctcctgcctcaggctcccgagtagctgtgactacaggcacccgccaccacgcccagctaatgttttttttgtatttttagtaaagacggggtttcacagtgttagccaggatggtcttgatctcctgacctcgtgatccacccgccttggcctcccagagtgctgggattacaggtgtgagccaccatgcctggcctaatttttggatttttaatagagaccattgccatgttgtccagactggtattgaactcctgggctcaagcaatgcatctacctcagcctcccaagctgctgagattacaggtgtgagccaccacacctggcctccaagtgatccttccacctcagcctcccaaggagctgggaccacaggcatgtgccaccatgcccagctaattaatttttttttttttttttttttttgtagagacaaggtctccctatgttgcccaggctggccttgaactcctgtactccagcgatccctctgccttggcctcccaaagtgctgggataacaggcatgagccaatgcgcctggcatccctgtctttagcttgcctattttcctaatgtgttttcgtcacaagtatttataagtttttttcttttatagctaaggtttcccattagctataaaagctgtaggtcctaggaaatctttgtcgactcctaagctacaaagatgttttcctctagaagctttatagtttttgctttttcagttagaatttagaattattttctatgtatagtatgtgggaaggggcaatttttttttttaagcccacatggaaatccagtttcgccaacaccatttgttgaaaagacacttcttttcccttgttgtattgctttggcacttttgttgaaaaccaaatgactgtataaacatgggtctgtttctgggtttaccacttggttccactgatcaatttgattgttatgtcagtatcatattgtattcatttccttgagctgctgtgacaaagaaccacaaaccaggcggcttaaaacaacaaaaatgtattatctcacagttctggagtctagaaatctggaaccagttgttggtagtatcacgctccctatgaaggctctaaggctcttcctggcctcttcctagcttctggtggcttctagcaatccttggggttccttggcatgcagatacatcagtccaatctctaactccatcatcatataagcgttttccctcagtgtctttgtctctgtgtcctttccttctctcataaggacaccagtcattgatttaggatacaccataatccagtgtggcctcatcttaactagttacatctgcaaagactgtatttccagataaagccacatcctgagagtccaggtgaacattaatttggggggacattattcaactcaccacacatactgtcttgtttactgtagtcttattgtaagtatccaaagcaattcacgtaagtctgcaaactctgcccttcttatttacaatttctttgtaaataagggtcctttgtgtttccatataaattttagtaatcagctttgcattttctacaaaatgcctgcttggtattatgattggaactgcatatagggagaactgatatctttttatttttttgagatggagtttcactcttgttgcccaggctggattgcaacggcatgatctcggctcgctgcaacctccgcctcctgggttcgagcaattctcctgcctcagcctcctgactagctgggattataggcacccaccaccacacctggctaatttttttgtacttttagtagagatggggtttcaccatgttagccaggctggtcttgaactcctgtcctcaagtgatccacccacctcagcctcccaaagtgctcgattacaagtgtgagccaccgcgcccggctgagaactgatatcttaaccacactgagtcatccggtccatgagcatggtagatattcttttattcaggttttcttcaatttctcccagcaatgttttacagtcttcaagatactggtcttacacattttttgttaaatttatttctaagtattttatggttttttaacactatttttaatgaaatttttaaaatttcatttatggtaagtatataaaaatataatgatttttgtatactgaccttatgtcttgctaaataaattagttctaatagttattttttaggtttcttgggtttttctgcataaacaaacactgtcaactacaaatagaaacagttttacttcttcctttctgattttcaaacattttatttctttttcttgccttactgcattggctaggatttctagtacaatgttaataagaatgaagagcatggctgttcttgcttttcccccaatctttgggaagagtatttcatatttcaccatgaagcatgattttagtagtaggtttttcacagatacgctttatcagattgaggacatagttgttaatagttttgttgttgttgttttgtttttgttttttttttctggagacagtcttgctttgtcacctaggctggagtgcagtggtgcgatcttggctcactgcaacctctgcttcctggattcaagcaattctcctgcctcagcctcccgagtagctgagactacaggtgcatgctaccatgcccagctaatttttgtaattttagtagagatggagttctactatgttggccaggctggccttgaactcctaacctcaggtgatccacccgccttggcctcccagagtgttaggattacaggcatgagccatcactcccggcctgctaacagtttttcactctgaatggttactaaattttgtcaggtgcttattctgcatttatcacaataatcatacagcttttaaaatataaatccaatcctgcatttctgagatgaactctgcttagtaatcatgtattatcctttttacatatttctagatttcatttgctaatattttataaaatctttgtcacatactagtatgagaggtatatatatatggctttataaatgagttggaaagtgctccctcctcctctcttatttgagtttctgtgaacttagtattatatcttccttaaatgtttcggagaactgatcagtgaaaacatcttggtccacatagtaaccaatgtttaattaggcatattttactaggtattaatcctttgtctcatatatgttaaaatagtctcccctgtctgtcatgaaaccactagttttattatttttattttttaatatctagaatatagcatacttgagcccctttttcagttttatctttatcctttctgttgcttgtttgctactgtccagtgatacttaaccatttgcacctccctaatgtaccatactgacttcattaaatactatgatcaaatcacaaccttttgaacctattttcttacttataaaatgaaaatatcttgcagagatgtggtcagaattataagcttttcaacaaataacagctagtattatgatgatgatgatgcattattttaccctctgccttgtttaacattttactaccattaaaccacgaattatgcttcaggactcagttcccatctccctgggaagccttcgctgattgcctgactgccccttactctatgactctagagccaaatgtacatacttgtattagaacacttactgcggttattacaattatttatctgcatttcctgtcctctgatctgtgaaacacacaaatttaaacatcttgtggccccccagtactaagcatagtatttagtgctcattatttgctgaataaagagttgataaaaccaaaaacattgcattttatcttcaaagtatccttgcaagatagaaaggataagggcatctagagagactaaagctccaagaaataagcaatttgtccacattcaaaaacccagtggtggttgggggcagtggctcacacctataaccccagtattttgggaggccaaagcaggtggatcacttgaggtcaagagttcaagaccagcctggccatctctactaaaaatacaaaaattagctgagcattgtggcccacacctgtagtcccagctatttgggtggctaaggcatgagaatcgcttgagttcgggaggtggaggttgcagtgagctgagatcatgccactgcacctccggcctgggtgacagagcaagactctgtctcaaaaaaaacaaaaaaaaaaaacaaaaagacattgggactagatgccagagtttttcttcccaggttcacaaggaaggatataaaagaaatactggccaagaaactggaagactagttataggcctagatcggcatttactctcatattaaccacagaaaaatccctaaattctttatttcctcatccatagtaaggataattctactataactttaacttacagagttacgaaagctttcagatataatagggttttatgaattctaaagctccatataaaaagtattaatgtctaatgggccagtaattcacaaactttctggagcctccttcttctttgatcacccccatatcaattaactgccaagtcctatattgattgatccagcaggatctcacatatttattacctcatcttaatcactactaaactaccctcagccctcatccagtctcatcaagattactacaataatctaactgctgccctgctgatagcccaccttcagtttctgcccaagtagactatgatgtgcttctgctccacttcaaagctttcaatggctttctgctgccttttcaatacagaacaaatcccttgaactaacagtcaagctcccttaccctagattcttatctagtctcattcagcacatatatataacatacacacactcacaaactctaccttctgtgcagcctacatactagaaactcagaaattcatttttctatagcatctgtttgtgctgctacagatacgatcctggaatatctttccttcttaactccaaaacttatccaaccttttgatcttgctcaaacaatagtttgcttcaagtctatccaaatttactctccagctaaaaagtaattctccctcttgtaatttatttgaactttttttcacaagacacttaagactttctgctttctgttgttatttatgaacgtgccttctagcccttactagaagctcctttaagacaagatttatgattgattcaccattcctacaacagtggtgttcatatgtaaaactgtcaataaaaatatgttaaattaactgacactttctatctggattagctgattttacaaagctcatcctcctcctctccattgcctttcagaatctctattacttagcaaaaatattatagttttgtgtaagttgattaaactgtctataggctaagctttctatactggaactacctctaagttttcccaactctaaagcacaagctcacatttcaaaaattaaaagtacaaaaacattaaatgttagaggaaaaacaatcatactactaaattatgtaagggtaaaaaaatcaactggagaaggtgaaagtttctaacatttatctgtgcacaactcaggctgacactttgaagagaagaatgtgacagcttacaagaaaacaaactcactcattccccttaatttctgaaggctcatgaaagtctgacaggccagccacagggtgatctctcatgtgtatcgcccatgacaattatggcttcaataaaaatggtctctatttttaataaactccaactggttttcaggaaatagccaggctaacatggtcatatttaagaaggcatatttcaccaattagcagctaacttatttagttcatggacctaaataagactgtgcatggagaggtacaaaatcagtgtggtagcagagggcaaggtggtgtgaaaggctgagtccaggggtcagctgtggtgacacatacaaatggctgtgctgaggatcaccttgcccctctactttcttttggtttgatttggttttcctctttaaacagctattaagagtctccctatgaattttcaaagtgtttatgactcaaatctgggaaatactgataaaaatcacagctcattataagcatttgaaatgatttgccctaacgatagataaatgaaatataacgagtttttaaagtactctgtaattcacactggaaataacctgcagttgtccttatattaatttgacagttgcttaatatgaaataatcgggctgctatacagacactttgtttcctccccatcaaggattgccagcagaagggggaaaagaggaaaagaagtgctaagcaatgaaacctcctttcatttttagtctccactcctatggcccagctcttatcagctagtgcaggacgaaggaggaggaatgaagggagaaagagtcctcctgccaattctcaccacaaccctacttccaatctctcctaagcactgctgtgtttctagtgacagaaatctgcattagtttttcacttcagaaaacaagccatcagaggtttaaaattcacagactttctggatgtggtggaaatttccccatcatgactcctaattccaaataattaacaactagtctgggaacacaatcagtttaggaagaagatcttcatccaattcttgaaacaaaatatgcctctaatcaaaaacagtcacactattttcctacacaaacttcattaaacatgaagaatagaattgtgtaggtttataaaacatgaaggaagttcttctttaaacagtatttattgcacaatcatatcgattttcatgctaataataaacagcagaattcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaattcatctctggtgtttctgttatctctcacagtgagaaataaagaataaataagaagaaaataatttttttaaaacaaatatcacaaaggattaatattcttaatatatagtctctataaaatttagtatgaaaaaaggaatctaaaaggaaatgcatgaattataaaaaaagagaacttctagattcagctccaatacataaaaggcctggaaatcatctctcccatccttacaacaagaaaaagctagaacactgaaaatcaaccagtgttccaggacctgttggagactcaagggctcagggcaaacctccacctggaaacctggagagttcagcagtctggagtcctagttgggctcagctcacctcgagcagaagccactagaaccacagactggtgggaacacttaggtggtattttgaggaattgctgggaactgagtgtggagtagaacaaaaatgagaaactctagagggctgcagtcttagaggggtcctcattttcatgggccttaagtctaggagccccacaaggtggccatggtgaagatctgagaaagatccccttgtacatcttgcagaggacagggaagtgactttctaccaaaaatacaggatggcaaaggatttttttaaaagagtaactttacagtggagaaacctggcaaacactacttgggccaggtggtcaaggtcactgtcaacagtgataagtcatgtggatagcatgttccctcgatatggtgtgatgataatggcactttactgttgtgggcttcctcccaagaacccagaccctagcacaatcatgagaaaaacatcggacataccccaactgtgggacattctacagaattcctgatcagcactccttaaaactgtcaaggtcatcaaaaataaggaaaacctaagaaacctttacagtcaagagggcctaaagagacatgaagacaaaatgtcatgtggtatcctggataggatgggaacttggaacagaaaagggacgttaagtgaaaattaaggaaatctgaatcaagtatagacttgagttaatggtaatgaatcactgctggttcattagttgtagaaaatgtgccacactaatgtaagttgttaacaataggaaaaacagggtgtagagtacatgggaacttggtaccagcttcacaataattctataaatctagaactgttataaaattaaacgtttatttttaaagtaagaaaaacatgcagtatctgaataatcaaataaatataaattaaaagtaagaggtgtaactttttttcatcaacacattcatcaaaacttgaagttcaatagtaatcaatcctggcttaggtacaataaaacatactttcctggattgctgtcagttagtataatgatttagaaagcaagctttgcaatacagttcaaaaacacactaactcagtaactctatttgtaagcatctattttaataaaataatcagaaagcagataaatgattacgtataaaattttgcatatttgcctcattaaaaattgtaaaaataagtaaaactgaaaaactaggaaaaagacatcatagcaattggtatgggagatactgccccactgggaatcatataaaagccaggctgaacacagaaaacaactgtttcctgagtttgggcagcagacaccccctggtgtggtctctgaaagaagagctcacccgagtgggtaccacctccagattggctttccccaaggatgcccttcaaagtgtaacccatggagatagagccagggagagacagtctgcttgatcaccatgcagggctcaaaattgttcaatatttgaaaatctgtcaaggaaatattttcaattagcaagttaaagaagaaaattcataggatcatttttaaagacgtgggaaatgcatttgaaaaaaatcaaaacccatttataataataactttgagctgaacaagaatggaagagaaattctttagggatgggtatatgctgaagacgctatcaaataatgcactgaaaggtgaatggttgctgtattaccactaaaggaagaaggaaggaaaagaatgtctctccccatcaccaccattaaatactcaacatatattgaaatgttcgtcaaggcaataacaccagaaatgtttacaagagatatgatattggagcaaaagatctaacgctgacaacattagcagataataccattacctaggaagtccaagggatttgtctttaaaacatactataaccaataagacgttcagtaacatctccagtaacacctgtgtgaataaaattatgacttcaattaaaaaaggaaacccaaataaatagatgtgctgtgtttctaaaggaaagacttgatattgtgaagatatacattctcccataattaacctatacatttttgagccattccaataaaaatccaaacttactatctacaaaatatgagaagctaacccaaatttcacctgagtgtgtaaaccagccagggttacagcaaattctagagcaggggagtgagtcaacaatggggcaccagatcactagatatcaaaagataaaccacaagaatcaaaacagaacagaattagccaaggaaaagacaaatcagtgaaatagaatacacagcccagaaaaaaaatattttaattcaatgactaaggaataatgaaatagctggcataggcataattgggatccacctgtgtgtcagatcaaggatggctccagagtctagatatgcctgccatcaagaggtggggtctctgcctcctccctttgaatctgggctggattttagttgctttagagtatgttggaagtgatactgtgccagctccagtccaagtctttaaggcaacagcagattctgtttcctttctctggtagccctgtgctgtcctgtgggaagtctgattgtcctgagttggccatgctgtgaggaagcccaggcttgccattggtggggggccatggggagggagaaaggggaagttgaggggccagcccatgactccttcctcctccatcccagctgagtgccccaacattgtggaccaaaagcaagtcattgctgctgtgccctgtcccaattcttaatccacagaatcatgtgaagtaatggttgtaaattattggcttgagggtaaaccaaattaggggatagtttgtcatgcagtaatagctaaccagaacaacttaggggaaaaataagttagactctctttctacactataaataagttccaaagggatttaaatatataacttacaaagcaataaagtactagaataaaactaagaagactgatagtttaccttgctaggaggtgtagaaaaggcaatttcatacattgttagtggtagtgtgaattgctacaactttttggagagtgatacacaatatctattaaaattatcaattctgagaatctagctatggaaaccaagttcaagttcttatcaatatataagactctctgtaagaagatgcctatcacagcatagttataaaaaaaacaatgaaacagtttggatggtggaatcaattgcatcctatccacacaatggaatgttatggagctattaaaaacaaaaatgctagatctatgcttatgaacctggagggattttgtcttattcagtttgggctgctataacaaatataccccatagatgggtgttttaaacaacacacacttgtttctcacatttctagaagctggaaagtccaagatcaaggtgctggtagatgtggtgtctggtaagattagacagacaccttctcattgtatcctcgcacggccaagagaaaaatctctctcctcataagggtcctaatcctattcctgatggctcaaccttcatgatctaactacttccccaaagccccacctcctgagaccatcacactggaagtttgaatttcagcatatgaattttggggagatacaaacatttagtccaaaacagatctcaaaaattaatttaaaagtagtttcacactctggaagatgatttggcaagttgttaacaaataaacatgcaattatcatatgacccggaaacttcattcttggattttttttcctgagagaaataaaacttgtgttatcacaaaaacttgtacacaaaggttcataaaagctttattcaaaatagccctaaaatgaaagccaggctagatgtcctttaacaggagaatactaaacaaactgatgaatccatggaatgctactaaacaatgaaaaggaacgaaatattaatacacacagtaaataacctggatgagtcagcaaagaattgtgctgaatgaaaaaagccagtcccaaaagattatatactgtatgctccatctgcacgacattttgaaataacgaagctgtagaaatagagaacagattaatggttgttggggattagagattggaggaaggtggacgaatgtgtgtgtgaggaaggggacaagaagaaggtgaggagtaatgaaaaggcaacaagagggtccctatggtgatgaattgttctgtatcttgactgtgatggtggccacaggagcctacacatgtaatgaagtagtgcagaaatacacgtgtgcgtgcgcgtgcacacacacacacacacacacacaagagtacaagtaaaaccagggataacatcaatggattgcatcactgtcactatcctagatgtaattttctactacagcttcacacaatgttatcctcggaggaaactaggtaaagatacacaagaactctatattatttttcacaacttggaagtgaatctatagttaaccaaataaaaatctaaattaaaaaccttttaaaaatattataacaaaatctataatacagtaaaaaagtagctttcagaggtatttaaatatcatcttcccattttggtaaaacaagacaaaatgaaacttcatatatttgaatatatatttgaatgagcacaaggtgtgatagacagagctcaaactattaacactggttacctatggaagccgggatggaggagaaaagaaatgacattatcaagttatcaagatgacattatcgacatattctatgttgacttttttttgctacattaggatgcatttttataataaaaataaatattggaaagagctaaatgaaaaaacaaaaccataaaagtgatagggaaaataatatattatttttacaagtttagggtggagattccctttccaaggaaggaagattcaacacccagaagccataaaggaaacaactaacagattcatctcataaaaaaataaaaactcccacagatcaaaacacatcataaagaaagtttaaaaacaagtaacgtggaattttctaacaaacgaaagattagtagccaaaaattgtccttacaaatcacaaagagaaaacaatgaaatagaaaaattggtgaagactttggccagaccactaggataaagcaataatgttgactgctaaaacagaaatctttcagccttggtttggcctgagactctgaaagtcaagaacaagacagcaggtgccaactagccccagcgtctacatgctggaccccgatgcaagacctgctcagaggatgatctaaccctccacctcttacccaaaggagaggcagagggagacagggcttcttgtgaagagttggcagtggcccccgaggttccttggagacacacatgggcacacacacgcatgcacactcagacacacacggaggaggaaggcaatctgcttctcagcccatgccagagggcagtcacactgtgagaggaactccaagatgggtcaccaggagaatgtgacatgcgtccctccaaagactgaaggtgagggtacgtggctatgtctgctctgcccaagctggcacaaggggaagcaaaggacagtgaagagaggggaaggacctagggcatctaggccccaaattacaggctgatggtggcactacgagtggccccagtgaaaggccttccctctgtcaagaaaaggacaatctgggtccacagtggattgggccttcatcagcccccaaagcatcattcaaagagagcatcagaaattgcacccagaagtctgaaaaaccccaagctgtatgacatcagccactttgtggccttttttcctaatcctttctccttcctgagtccagcttaagaaggataataagcagttcctgttgagttgggggaaaagaagggtgagaacagctgagtttctctaggcagctcctgctggaggctggggaagctttcactgggatgagagcccagagtcagatttacgctggtcctgactgtgctgtgcggtcctgacagtgctgtgcgatcctagactgaccgactagactgagccactgaaaatttagtgggagttgccccagattttattgaacagcagggaaggaaaaccaggagagcagattggaaagggcaatagtgagaactacagaagcggtcctccacttggcccccggtgaagtcccctggatcctgtccagaaaggtcctcctcaccagcaatcaaaaaaacacaaattaagacaaaaatatgtttctctcgattcagaggggcaaatatgcaacatgccaatgtggtctcaggatggtgaggaaattgctcatgcatcactgaagagcctgggagtgcaaaaactccctccagaaggcaaaatgcagatttgctgaaactaaacttacactttacaaaaatcccacttctaggaatatgttctaaaacatctcttgtatgtgcataaagttgaatatagattcattgcctcattagaaaagtgcaaatttagaacaatctacgtttccatcaataagggtggctaaacaatcatatgaagaaagctctacatcactgatcattacagaaatgcaaatcaaaaccacaatgagataccatctcacaccagtaagaatggctattaaaaacaaaaaagaaaacagatgctggctaggctgtggggaaaaaggaacgcttatacactgttggtgggagtataaattagttcaaccaatgttgaagataatgtgacaattcctcaaagacctaaacaaagaaataccattcaacccagcaatctcattacagggtgtatgcccagagcaatataaataattctgttataaaggcacatgcacatgtatgttcattgcagcactatccacaatagcaaaaacatggaatcaatccaaatggccatcaaatggtagactggataaagaaaatgtggtacgtatataccatggaatactctgaagccataaacaagaaggagatcatgtcctttgcagggacatagatggagctggaggtcattatcctaagcaaactaatgcaggaacagaaaaccaaatactgcatgttctcacttataagtgggaggtaaataatgagaacacatggacacatagaagggaacaacacacactgggcctgtcagagggtcggagggaagagggagaggatcaagaaaaataactaatggatactaggcttaccacaagggtaatgaaatgatctgtacaacaaacccccatgacacatgtttacctatgcaacaaacctgtacattctgcacttgtactcctgaacttaaaagttaaaaacacacacacacacaaacaaaacacgatgactgcatacacacacagaataagatgcagctggtaaaaagaatggctctatcttctgatataaaaaagtctccaagacacaggaagtggcaaaagcaaatcacagaattgtatccaatgtatgacactccttacattaaaaagcaaatataggccggccacagtgacttacgcctgtaatcccagcacttttgggagggcggatcatgaggtcaggagatcaagaccatcctggctaacacggtgaaaccccgtctctactaaaaaatacaaaaaattagcccggcgtggtggcgggcccctgtagtcccagctacttgggaggctgaggcaagagaatggcgtgaaccccggaggtggagcttgaagtgagcgaagatcatgccactgcactccagcctgggtgacagagcaagactccgtctcaaacaaaacaaaaaaaaaagcaaatatatatgtatgcgtgtgtgtatgtatttatatattcatacatatataaatatgtaaaaaataattagagaattctcatcaaaatgttgccagtggttacctctgggaaggtagtggttacctttgggagggtagtgggtacatgtgaggagaggttttttgtttttttgtgttttttggagacagggtctcagtctgtcacccaggctggagtgcagtggtgtgatctcagctcactgcaacctctgcctcctgggttcaagtgattctcgtgcctcagccgcctgagtagctgggattacaggcatgtgccaccatgcccagctcatttttttgtatttttagtagagacagggtttcaccatgttagccaggcaagtcttgaactcccaaccccaaatgatccacctgcctcagtctcccaaagtgctgggaccacaggtgtgagccaccacacccgcctcacgttttttattgagtaaacttcactgctatatgaatcttttgtaatgacaatgtatttatatatgtgtatggtcaatgttaataaaggttagagaagttaaaaatgaagaaagagtactgtggaggatggagtggatgaagggaaaagccaatcagagaagcaccctagggtgctgtagcagtagtccaggggacacctgtgaaggctggaattagacatgggcacgggaggagaagggggagcaggtgagcatgggcttaagaggacaactggcacagtttgttgactgtggacatgcgggctgagaggaagaaaatagattaatgtgatgactaatgtagctgatgacaactgtcccacacttcgagcaggggcccagggcaaggagcagggtggggaaggaagcagaggtgagagttcatatcccaggggatacacttctggcccatcagacagtggagtgtgtgggcacacacctcaggcggcagatcttggagattccaatttgtatttctgaacatgtaagtggctttgagcatgatcaaggtgaacaagaatagaaatatggaaggcaccaacagatgatggacagatgaggaaggagatgataactacagcaaaaaggccaaccacaggagaggctgccatttgttgagcaagtgagatatgctgtgtgctgtccctttattttattcaatcattataataatgggaggtgggttttatcatgattcccattttataaatgagcaattggaagcttagaatcaccaaataattttcccaacatagcaaagaatccagctctggctgactccacactcacagcaactacaccacttcgcttctgccgaagcaatcctacttgcactcctccttttggattgctgagaagcatcactatctaattaccataaagccccctcctctccatgcctgctatctttgtcctggtttgagacctctttatccctcccatccctaccttcagtctatcctgcacaggactgacaaagtcatcttccagaatcacaagcatgactacatcagtattctacttaaaatccttcagtaagtattctctctaccagtcgagatgctcgagcaaggaacagagagatactattgtctgaaacaaccacaaagacaacaaaacacatgaaacaatgggtttcttttttatttgtttttgtttttcagcttatattttagattcaggggtaaggaaggattttacctgaagccttagcgggagcatggaccttgagaccttgagtttggacttccagccttcagaactgagagggaatgcattcctgttgtcttaagccacgcagtttatgattctttgtgacagcagccctaggaaactattacaataggtttatagatttcatcagacttggaaaatatttgaccattagttcttcagttctttttctttctcaccctctcttttgctcctctgaggactcaaatgacctgtaaattaggccactttaaattgtcccacagttcactgatgctctgggagtcttttaaagacttttttttttttttttgagatggagcgtcactcttgtcacccaggctggagtgccgtggtgcaatcgcggctcactgcaacctctgcctcccaggttcaagtgattctcctgcctcagcctcccaagtagctgggattacaagtgcctgccaccacacccagctaatttttgtatttttagtagagatggggatttcaccatgttggccaggctgatcttgaactcctgacctcaagtgatccaccccttcttggcctcccaaagtgttgggattgcaggcctggaccactgcacctggcccaaagactttttaaaattttctttctgtgatttctattgctacgtcttcaagatcaccagtctcttgtgatgcctaatctgatattaactccatcgtgtgtattttaaatcttatatattgtcttttgtttggatcttttaaatatcttccatgtctgtacttaactttttgaacatgtggaatgcagttataataacagttttactgtccatgtttactaattgtaacatccatgtcagttttgcatcagtttcaattgattaactgtctctcattatgggttgcatttttttgcttctttttttattcactgctagacattatgaattttaccttgtttggtgctagctacttttgtaatcctatgcatattcttgagctttttatatgcagttgaattaactgaaaatcgtttgatcccttcaagtcttgctttcaaattttattaggcaggacaagagctgggtttagtgtaggactaatgatagccacactcatgaggcaagaccttttgagtactcaatgcccatgaattgggaagttctccagtctgtctggtggagacaggtgttgttcctggcagcactccattctctgcctttgtcatcacatgatgtttgtgtctcctcttcttgtgtacaagaacaccagtcatatcaaattagggttctccctaatgacctcattttaactggagaaaccttaactgattgctttctgcagccaaccagaggtaccttcaattttccatttgccacagagaaaaggggaaagatttgcaaagggagcagccttgagtccttttgttactgaggcatggaaagttggggttttcctctcaatttagttctaggaagtcagtgtgaattgatcttagattccctgcctccagaccctgttctcctgcctcaataggagagaaaagctacaacaataagtgaatccgcccaggagatccataattgaaaaagttttagaaaagagaacagagaaagtatatggagtgggggtcagtaattaaagaaaacaataaaataaaatgtatcagattttgcataatgatcatcagcctctagtgtgaaaagacccactgaataacccctaagtgaaatgagatccacgccaaccagagcactccccggataaaagagaaaatcccgaaatatttcagagagggatctggccttgtatgaaagaagaggggtgagaacggtgtctgacttctggtggcagctctgtgagccagaagttagtggccatggcttcaaattctaggtcaagaatctccgaccaagctgccaatcaaacatgaaggtagaataactaatttttgcacatacaagctctcaaaacatttcccagtacaaaacattcttcagaaagctatagagagggaaaaaaacaagagaggacccatctttcagcaactagagacccagcgcagggaaggcaaaggggactcccagaaccccaagacaaccgttggaccaccacgtgtgctggggcaggggcctgggaggatgtcgctaggagaggaagcccagccatgatgcatctgcaccactgcaaagagagcccccttctggcccagagtctagggatgagtgggaagacagcactaaaccaagggaaatcttggcaactgtttattccaagtaaaacaaaaagttgtacaaaataggaaatgtgcactgcatggtttagctgtgaataatacgaacatagtcataactatgtaaataccaaatattgatttggccaaaaattaggctgtaactaccatgatggggttgagacaaacagagagacagcacgtatgcacaggaggatggtgtttttaaagagcgacatcctcctcttccatggtggaagttcatcccgtgacatttaaactggaaaatcaagaaatggccttctaaacttgttattttaaagtcaggaggaaagcaccagaagaaacggcaggaattcaaagtgattgcctctggggaacgggaatctggagtgggaagaggaacgctgtttctcattacaaaccttgaagaaccatttaagttttaaaactacatacatatatgactctgataaacatacatttttaaaactacttacaaaacagcaaggaaaagattaagaagggtgaaggcagcacatttcagactgtttcagcgacttacctccaagtgagtaaatacataactcagtctatgccatttaggcatagacctaaaggggtggcatccagaaatttcttcaaagtcttacttattatctttaaaattcaggcagaagtttttactctctttcataatacatccctgtttgtttttatagtatgtggcatacctggcagaaggttttcttttcctctccttttgccttctttctctttcctgagacacacatcaggctgggatgacagagaaagacattctttcagtagaataaggtatagagggtgcccgtaggattaactgggaagggtgaaatatctgataatttttcagtcattacggactagtactaccaaggccccttatagcatctgctcaccccactgtctaagcctggtgtctctgagcagggaactcagggagcttgaagactggacccccagcacaaggccagggtgggaccctcttgggatcaggcggcagacaaagccctggaggaggggaaggagatggagtccaagaaggaaaagacatctcagtcttagcatcagaaagaccatggggttgctcccaaagagttagacctaaagccccacagcagagaaggaatctgggaaggtgggcttcaaggaagaaagtggagaatcccatcccaattctccaactcctcttgtgaattctggaatcagtacagttgttatactcacagcaaacatcgttcagggtcttcttgcacaacagagctttcaaaaatatgctgtgatttcatcagtttcctttattggccactgatatgcaaagtctatcctgaggctcaggatcccccaagttctcccaaagaccctcgggccccagtctaggaagcatggagatgacaagtggaaaacagtggcatcacacatgggacagatgatgtgaagttggcaggaaaattccctgggatacgacttttgtgggggtctctccacgtcctgccctgttggaggctggaagcctctgtgctctctacctcctgggggggcagcagggcagaaaacagaaggttctcagagagtacccctgttcctagctcttgttcttcaaacgtcaggaagtgtgttgggaagaagaaagaagttagctgcagaagccgggagggaaagaggaaagattgtgcagccatcgagggaggcaaagtccatggctcctggaggagagaccctgcctggctagctgtcggtgctgaggaaagcaacttctgaaagcaactgctagagggaggcatggaatttccactcctgtgcaggttgctgtgaccttggggtccagatgcacggtgcccctggccttgaggagaccaggtaggctgtgttctccacattatagccctaacgggtgggttggaggacttgcttgctgctcttgtgggaccttcataagcccaggattcaaaaggaaccttcaatataactgagactgaattatttccagccaggcagaagtgccagaaattcaaagagtatttgggaagcaaggcatatgcctgccgcttaagttattcttgttgttttgaattatgaactcctttgcttcaggtgatgccccatctggcctggcatccaaggcaggtgagaatttcctccaccaggctttgcttggcctgggatgaggaattcgactggaatcacactcactccaccttcccacatccagacacaagcagtcacctttagggttttgcctctctctgttccagacagctggttccagagtcagctgtcacaactgaccctgacagctctagggagaattagcaaggcagaggaagggagtccttggacagagaggagggtggacaaggaagagaggagactttagagacaggcacatcccacaacctccggtgttaccatatccagcaggctgactgagccgcactgagccctgggcagaagtgggtgatctctgagctggggctgggtttcatttttcttgtctctctgagctcagccaccaggcgatacccaagttagtataccccacccacactgtggccgtgtcccagtgctccaaacgccacattgaagggagctggtctcagactgcagagctcacatgtgacagacataaccaatggggaagaaagagtcgtcccctcatgagtctgaagccagtacctaaaggagagaatggggaggcggcaaggcatggccccacagcagaggtcggaaggaagagctcccagggttaagaagcgaagccccgagacacagccaccattcccaccaccccagctcagggctacctttgggacccacccaaaactcagctaaggccagggaggaggggtcctcaaggacaagctgcaggcaccaagccctgccatcaggcactggccagactggagtgagaagccctgtgagcacatactcgctcctctacttgttggtcttggttttacgtgtcaaccgaggaaacagggccagtgtgtgcaatcgcctatggttggaggcgtggtggaaggcgagccccttctccccaggctttctgaaaccatgtgggagatctctaccagagtgacactgcctgcctcccatccccaccccccactgctggtggcgatgggacagtccagagtcctagtttgggtaggacagaaccatagaaaggcaaccccccactccggagtctcattccctcctctctgggtcactttgacagtcttgcctgctccagcattctctcggggctgtcggaaaagtgacagggagtgggcacagggttagggaggtgagtgtgggcctgctgctccatcggcagtgccgtgaggaagctgctgctccttctccagttctccatctcctgcatttcacttctcagctagatgtaagtggagaagaggaataatggggtgttatttatgagtcccttaaaacctcaacaaccctaccatgtgtcagacgaggtgcctggagctttgtcaatccctcgtgtcattttgtgccataactctccaggcgggaattatcaccctgtgcatgtgagcctcagtctctgccattcccacccctgcgctctttcctccacactgcaaagtccccatcggtaggagtacacttgtctctcagggcttgggtgagaagccctgggaacctcatttggtgggaagcttttgtcagctgcagagcatcaagcaagccttgggctctagattttgctgtgcctcgcattgctgataatccaatggtgtcttgcctccagctcccgaagtccacagatgtggcagcgatcatggccctgttccctgctctcctcagcccacacgttccccttagatgacttcatcggccacaaggctccaattaccggctctctgctcagatttatgtctcccgcccaggctgtgtgcagggatccaggtgcacacatccaatcctgtgcacacctccctcagccgtctgacagctgccgaagctcccaggtctacatccacttgacatctgcttctccagatctgctcctccagggtcctccagaacatggtactgtccttagacactggcccctctctcaacacccgtgtccaatcaggctctgagtcagggtaggtcaaactgagaactcctggccctgttcacatctctctctgcaaaggccaacatggtttctttgcccgggttatgtgctagcacctaaactagtcttccattcccaccttggccccatcaaatccattctgtgtactacccaatataatagttcttagacacaaatctgatcatgtcacacagtcgtttaaagcccttcaaatcctcccagtgcatttggagggaaactggatggctgacgggggcccaggcactacagggctggcttctgccccttcttcagaactccagccacagaagtctcctttttgttctcagaagcaccggctctttcccatcaaggctcccacacgtgtgtccctctgcacggcctctcattcccacactttgctcagccaactgcggccaccttcagtctcagatggcattagatggcacttctgcagggaagcccatcgccctccagattgacctgagaccccccgctctctggaatacaggaagactgaaaaaaccttactgtgttttgaactgtaatgtgctgtttacacttgtgtaatgactttcttccgtgagggattatggtgccttgaatacagaaatcagggcagcctgtttctcaactgtgtcctcagggccttgggcaggtctagcatgaagcagggattagtaaacatcaatggaatagattccatggaagaggctattaaaataagttgcaaaatactgaatatattggtttttttagtcaactataattttagagcacctgtaggttcacagcaaaaactacagagatttcccttataccctctgccccacacatgcaccgcctcccccattatcaacatctcccgccagagtggtgcatttgttacaattgatgagcctacagtgacacaccagtatcacccagagtccatgattaatttgagtttactcttggtgttgcacattttatgggggttaataatgtcatgtatccaccattgtgtcaagtgagggaagagggccagtgtgtgccatcacctatcattggaggcatggtggaggatgagccccttctcaggctttctgaggccacgtggggagacctccaccagagtgacactgcctgcctcccatccccaccccccactgatggtggtgacagcacggtccacagtcctagtttgggtggaacagggccatagaaaggcagcagctccccaccccgaagtctcattccctcctttctgggtgagtttgacagtcctgccatccccggcactctctcaatggtatccacatcgtagtatcacacagaatagcttcatggccctaaaaaacctctgtgctctgccgatgcacccctctgtccccccaacccctggcaaccactgatcttttaattgtctccatagttttgccttttccagaatgtcatatagttagaatcatacagtgtgtagccttttcagagtggcctttttcacttagcaatatgcatttaagtttcccccatgtctttccatgtcttgacagctcattgctttttagcactgaatcatattccatgtgcctggatgtgccacagtttatccattcacctactgaaggacaatttgatgcttccaagttttggcagttatgaagaaaactgcaataaacattagttttgggggtgctggttgtgtggacataagttttcaactctttggggaaaatgccaaggagtgtgactgctggatcctatggtaagagtatgcttagtttttaaagaaatgtcaaactgtcttccaaaggaaactgtaccacgtttcattcccaccaacaaatgagagcattgttgcttcacatcctcccaacattggtgtttcccgggctttggattgtgttcattgtactggtatatagttggatcctgttttaatttgcaactccataatgacatatgacattgagcatctattcaaacacttatttgccaacttgtatcttctttggtgaggtgtccgttcacgtcttttgcccattttttaaatcaggttgttcgttttcttattgagtttaagagttacttgtatattttaggtgatagtcctttgtaagatgtgtttttttcaaatttttctcccagtctgtggtttgttttctcactatttcgaattatattgacttgacttaaggacaaaaacaaccctattttaaagagtttgtaatgagaatgagtacagcaccttcttcctagatctagaagcagtgcacagctgtggtttcctaggctttcctggccattagatgtgggtttgtcaggagcccacactggcctgctaagctgtggccactagtcccacgtctcctgggctagctgtactcttttgaagccagtgcctagactaatgctttggggtagaaaggccgaaagtcctctcactagagactccacctgacaggcctctctctccagggaggaggtggtggtgcctcaaagaagaggaattcccactcttggtcattctagcaagggacaggaaatgagattagtgactgggtgaggcacagggacttatttggagcattctcagggaaggggaaggcaatcttactccctgacagtgagggaggtcatgggagaggcagccaggaagcccccttgttccggtccagggagctcacccctgacagaggcagctgagagttgatatgcctgggttgatgactcttgcacccatttaatttaaaggataaaggtaggctgcagtgctttggggccaggccacttggttttgtgctcctttcaggttttttccacggggactgttgtgcatctcacagcactccacgtgcctaagactgcaattgtgggtgcatgaggaagacagagcccctccaactcttcctgcccagccgttggtgagaacagagccagagctggagctgcaggagaccttggtgcagtgcccagtgcacactgccctacctgacaattctgttgggatctgggggacagccaggatccagaggggctggaggaacagaacaaggccctggacataggctggccacagagcaagcgcagccaaagaggaagtgctgtgcctggtttctttccgccctccctcctccttcttccctgttaactgttctgctgggagcctccggatcatggattagggattgtggtgggaccctgtcagactcaccatgttgaagcaggtcaccaaaggtcacacagttgcccaggatgagaatgcctgtgcccaggggtgcatcaggtagagtgaggagctgggattggatcccttggccaggctgctgcttctgcaattatccagctaccgtaggacaggaataaaagaagccacagaaatcaaagagctgaggtaagcaggaaggcagggcgagaagggagggcccaaaacagcctttccccaaaacagactttgctcatgatgatgggaactgtcgagtcttttgagggaccaaaagggggacacagtagcagagctgaagggccttgtcctccaggaatcaggaaggaaaggaaactaaggcagccagagtttatgggtcagtgctgggccccaaagcccaaccgtgcaaagggttttggctccacctccagcaaaatgatgtctgatgatgtgtcccaggatggggtctctgccagccctcctactcattgatgctcaccctgcacccagaaccactcaagaagcagcgggggtgggatgaacctccaggatgcctgcaggtggggcagattcaggggtgaaattcagaactgatataagaaatagatttaccttgaagctaatgatgcttccagcacaggcctctcatttgtaggaaccccttccaaagccccaggagtggctctagcaatcaatgtaagtaagaagataacctctcattctactgggacctcccctgtgtcccacacaatgcactctgcccccatcaggtggcactggagtggccccaggcatatgggggatccagagaggttcagctgagaatatgttatttaatctataatctggaaagatgctttgaaaagttgcaataaaacaaatgagaagttatggtcttccactttggacagaaatatgattttgtcatccttaaatttttaattaaggaacagagaaaaaaattagataatgattaatggggccaggcatggtggctctcacctttaatctaagcactttgggaggctgaggtgggaagatcacttgagctcagaatgttgaggctacagtgagctatgatcacaccactacactccagccagggtgacagagcaagaccctgtctcaaaaaaaaaaaaaaaaaggaaaggaaaaaagaaagaaagaatttactgttaataaaattatgtttttaaatgttcatattttaccatgaagaagtagaaataaatgcctaataaaaataataatcaggctcttggaatatttagtaatctaatcaagagaagtgagtcctatgaagacattggggaaacttttaaatttattgatgaattaatcaaaactgacaaaaacaaagaagacactaaacatgaataccattaaaatgtgggtctagaagtgtatttgtcattcagagagcatttcaggtcagtcaccatacagaaaatttgacatgccctaaagtcatacagctcagatgggatagaaacatggttcaagtcttccctaattttttcaacaatttattataatttatatgacattatcaattcatcatgaagttgaaataaatttttctcaactaccgattttttcagaaaatgttgtttgaccagcactgccagaggaaagactgaaattacctttctattatgactctagaaaatcattgtcatatgaagagggaaacagcaagtacctagccaaaaatacaagaaggaaaatattacacagtatgtctggaagccagtaaataatatgtttttgcagagttttgtgatgtttacattatttatcagcttttaaaaaatgtgtagttcattttaattcttgtatcattttgaataagtattcacttttacacctagttttgtactcacaattttgttatcctttttctttacaaagtcccctacatttaatatggaatcgtagaaactagatggactgtgacagaggtggtgaccaggcatgggtgcagacacaaactctgcacggcctcagtcaccttagcccagaagccacctctaggccctgggacaaagagccaacctaaccacccgcaggcgtgcagccctactggcaggcactagctctccatcccccgacacctccccatggctcaggcgcccctgattcaaatggggaatggactggcatctggtcactagatatctcgtccccagattaacttttgagtcatttccaatcctgttcttttttaaagactgatggtgtgtactttcacactcctggaaagcaaataacatgagtttctggaggacaaactggcaatacatattcaaagtattcatactctttggcctggcaatcccccttacaggaatctatgaataggaatgatcagaaaaacagacaaatatgtaagcaaaataaggttcccacagcattgcatgacacaataccaacagtgttaacagaaagaaaatccttctgttatgtctctcccttgtcactaggtatccacagcctgaagaaatttaccaacatattaactaaaatgctctgagtggtacaattcggaggatggttgttttcttctttatgcattttgtgtgtgtgtgtaacacagatgagtttatcagaagaaaatgcacttttaaaatgaaacagtcgtagaaggaaatcaatcagacacctaaattaggaggctgacacaactgctcccaaaggaatgtcttagtacccctcagtatttctttaaaataaatggcttcagaaggctaaaaaatgggcctgcccacctcttttctcagggatccctagagcctttgctcagacactttgattcagtaatgctcataaatatggagcggccctttgcaagatcccttgcattttaatgtgggggtagtgctcacctcctccgtggatgggtgattgcaagcagtttcttggtcctcatttctgcaagagccagtgaggtgtgtggactgggatacttaagaaggagacacatggaaatgccatcttctgaccagggagtcccttggaccttggaagcaaccagagagcagagaaagaacagtagcccatgcagatgaacttacctccctcttctggccttgctgttgtcttctgtcaagtggggagatgactctgagtaatctctgagggctctccaattctgcacatgagcttcctacgagcagggaagttgactggcatggtggctcatgtgaaggccatggggaggacagggagttcacccgatccagcgcggatgcccttccttcatcttagcttgggcgggttagtatttctcatcctgaagtcaagctacctattctggtctcctggagtctcttctgacacaaggctaagttatgtaaatacacaaactaaacatgctttgcaggcataattttttaaacagagatgaggaatagagaaataaccaaaaaaattatgtacctttctgtgcctggtttatgtctgatttcacagaatccagcagactgtatacacatgggacaagcctgtgaacttggctatcacctctgagtttcagagggtgggtgacagacaaagacaggctggcgccacaacccagcacagcctgcagaggacacctacacatggggactcggtgtgggtcttggtggcacaggggagtctacattggccaggggagccctggggcccaatctcaggaagggatgtgccgcagggaaaatggagggccagaggagatcaaggtagagatttgtttctgtgtacggtgcagagagaggtccccaggtacaagccaagatgtcacaagtgcagggtgggtgaaaggcatctcagaggccacctgcagggaaggatccctactgacctgggcacctgaacacagtgtagcctgcaaacccgtcctccccagaggctctgcacccacacactctctgatctccctcatctggacttttataccaaagaggttttgatgcgcctatcagcttgccaaggccactgacagccacagaaatgcggtggagccaaccccatccaggggtcagtctttgatcctatttattatttagaccagtttgtgacttggtcaatacagatgctgcatagccaggaagcactgggtgcaggcttcgagctcattcccacagatttagtggtcagagaggaaagggcaacaccttggagaagcttgggaaattgaggcccaagagatgaagtccaggggattaactcgctcagcctcaactggcaaaatcaaatttggaagcagctagaaaaccacattgtgaataatgtagtctggcttggccccccacattgccttgtcgtgggcttccaaaccatccacttggaagtgccccatcaccagcctctaatgaaatgcaattggtgttcccgaccacgttcctaccttcaccagtcccagcagcccctcagtcccggccgcacacacttgggcacgccatgccagctgcaccaagccaatctgctgtgagatgccgggaaacggtttgcaaatattactttccaaatttatcacacttggcctggtaccgtggaaaaagttggttttgattttactgtggatgatcctgaggccccagtctgtgtcctactggggctggcttcgggtgctggggccgaagcctggtctcagagaggggccgggccttctcaagtggttctgctgccgagaaaggtgccagcccctccactgaccactggccacctgcagaagcccacctggctacactggccctttcctggcactttccaagccagcgaaggtgacctccctctggcaaacagaaatctgcgctgttgggagacagagcagtaggcatctatctccacatagctatcttgagcacctggtatgcaccattttgttagcatggaactctctccctatccctatctcagcagcttccttggagccagcagcaggcctgaggaggaggagaggggagtggccatccagctgtcaagatagaatccacaggccccataggagggacctggctgcccatcatagacactcagtctctcgctctgtggctgtcaagctcccaatatttctgtctctctcttcttttctgtctttatctgtatctttctctgtgtcttcttctctctctgtctctgtctccctctctgtttatccttctctatatctctgtctctgtctgtctctgtctctctctccctctttccctcctctccctctctttttctctctccttcctccccctttccttgcatttccctggggatgatggagttttcctccacgtcaccatgtggctagacaaatcagccctggcctttttgctcttgcatgagagtagaaggcctcccaaagcccctcaggttccatggtgtctgctccagccaggccccccaccaaaaccctctgaatcactggctctggggatggcaagagccctctttccctggtcctcacactcagtcccagactgttgagactaatgaccttgagtgtgtgtcacgtccctcatgtccccctctagggaaactggccagagtgggaaatcacagccagattttgggtcatgggcaaggggctgagggctcatgtctgtgaagagaggggcctcgaggggcccaggcagggaatggcagtgccgggagcactatggagagtggtggggtctgcaggaacctgccaccaactagattgggcagccgctctcctgccgcacgtctcctttcacatctgtggccagagtctccaacttttcaggagaaactgcagatctagattttcatatgaaaatgttaagacataattcaaagttttttgagaagcactctgcaagccaaataaaacacatcagcaggacggatctggccagcacagcacattcatgacctctgtttggtgtcccctaacacccacccctgggccccagccaccttcagggctggcaggggggcctctgcttccagggcccatgctcctccctcgccttcatcctggtcatggggctctgccttccccggagctgtcccagtgttcagatgaccctgaggcaggagcccacctgcagtacagcctccaggctggtcagccggtgtagacatctggtcattcttcatgtctgtcacctgcccagctggtcacaaagcagaggtccgagccccaggaaacccaggaccaccaggctgtggaggagaaagacttgctggtgtttcatggcccttgtttgctgttaccaaagctcatgtttaaacacaattactttctgctccactcaggcaacccagttggcacacccttccagggaccaagtcccatggcctttaaggaagccctagcatggggctgcccattccccagacatgaaaggcagctagtaagtttgctactcattagctgtgtggcctgggaaaatgacttagtttggctggcctcagtttcttcatctgtaaaatgggaacactatctcatgctagataaaaaaggacaaaattagacaaattagataaattccctcccagcttcacccatgtgcagaaatccttgaagaaggagaaggcgaaggagaaggagaaggagaaggagaggagaaaggggaattaatatttgttgaacctattatgcatgaggcaccttgacaagggcttacaaatgtcatctcaactcaccctatgaatcaccctggcaggctatcaccccacttcacacagcccctatttccacttcacagatgaaatcctgagctccaggtaagttgagctatttgtccccggaagggcccaagatttgaaccaagattcaaatttggtcggtctcaacattaaacctagaaacccggccagctgcagtaacccccctgcagtgccttcagcctctggccctggaccgacactccctcccatggctccaacatgtgtgggcccaggctccagcgccctcctcaggggctgccctgcctctgctcttgagaggacctgcaggcctccatcacccagcccacgcttcctgtctgtgttgcaggggtgcccaacccagtgctggcctcttcctctcggtgttgcaggcggcctgccaatgccattccttgactcaaatggactctgtggacaaaagaacactcccccaactactgccttcttggcccaggcaactccttctcatccttcagaacccagttcagacatacctcgtattgggggctgtgcctggcaaccccagctccccaggctgggctgaatgcctccctaggccacaccagcacccaccttggccttgatctcattcactatcagtgagtccactctgcagtgaggggcaacgctgagctgaggtaaggcagctctcctggggccactgccttaacctgagggtcccagcagctgtccctggggcccctggtccttgcctctgatgccaccctgtgctgctgttacccactctcaagcaaaccacaccctggtgggaggccctggggcggcagaggctgtgaggacagagcctgaagcctctgctggggtcccaccctgagctctgaaagaacccccaaatggaagcccccaccctctgtgttgcactttgcttttcccatgtggccacaggtcccaggttggggactgggccaccttcccttcctcttgctttagtttcatgcccagctccgggtgtcttctcgtcggggactctgcatgcctttctcagggctgagcagagctgaggggtccaggagccctggttacccccaggtgacatcccgtggtattgttagcatggaggtgatgtagtgaagacgggttgtcagctaggatgggggcgagatgaccatctaagcaatgtcagagcagggcacgtactcaaaaatgtacaaacgtatcttccaatcttccagctgttgggagagcttgggccacccaagggcacagcgccccctgctggccatgacgatgatgcggcttagctcacagggctttcctctgcagcagctccccagaagccaggcaggggagtgctgggcggggtgggagagggataggggtgtgcatgcatgggccatttctcattctctaacatacaaacgtgctctgacacctctcttgaggaccccctgtgcccactggcaccaccaacaaatcaatcacatagccaatcaacaaattaacaagcacctgcagtgtgcacacactggcccagactcaccttacctggatgctccccacctccactctctgtgttcaatttgccatagtcctcctgccccacctcccatggctctcacccccacagaactgccccttgtgccttcctcctcaaccaggtcctcacgcccccaacaggacacatacccagggcccaaccacgtggcctatctctgcactctcctgcacccatccatcccgcacaccacccacactccagtactcttgccaagaatgctcgagcattctcaccaccagctccacaacctccagggcttccctgtccttgagaaagagcccagggaaaggcttgggtgatcagacccaacctgcagacgcagccctgcctgcctgactcccactcaatctgccctctaagcaaactgcagcagcacagcaccattcccagaaagcacccttcacagcagcctcccacacatcttcacagccccccacctgcacaggcatactcagcctcacagagtccccctacagccctgacccctcgttcctatggaagactcacgccgaggccctcgtccattcccattgcacatggacccaccaggccactcacctcttcatctgagcccccacacccagaagcacccatgccccaacaccctctgtggtatccaccctcccgcccacactcagggttctgtacagaaaggagggatgcagggagtgtggtgagcataggccccgacgcccagtttccccagagaagcctttcagagaaatcgctttcacatggcagctttggtcctccgggagggcagcggctgaggagggggcatgacggggcagccagcgagaccattgttcacgccttggctgctggagccaagcccctaccccagtgccccttatccattggaggaggccgcaggaaaacaaggtctggtacccgaggggcccagtgacccgtttaagcagctcccctcaagcagaagtttcccacatgaccttccagccgggccctgggctttcctgcctccacagcaaccgcagtcccctcgcttggcactgtgtcttggcccagggcacaggggaagggaggaaatggggaggtggggagaggatgcacaggcctagcccgggctcccagctggcaacagcccttcttgtaaggacttctgggccctctgggtcctctgaccacctctttccaccacccaaaactggtcatggcctgcatgggtttggggacccagtgagctacactcacatcactggatgcttcaaagcagctgtgtgactccaggcaagtgtcaggaccgtgggttcctcatgccctcctggctatcaagcttgaagggcccacgtggagattcgagggaaaatgcacactcaggcccaggagcagtgcctcacaccagtgagtggagttcccttttaacatattcttgggtattgcctccacctagggtctgtttgtccccaaatttaagcttcctgggttctgactatgttgggcccagtggtgtggtctctgcccagctggatgtcagcctcccctcggcctcaagggcccagtgctaccacccatgtttccttaccatgactctgagcagtgctggtccctctctgagtcccaggaatggtgcacttgtctgctaccggtatctccactccccaagaaccttcctcacccatcctactgggccacccaggacttctggccctctctggacttctgacaggctctgctataagcccaggctctccacctcctcacacccagcccctcacagggccaacgcaccttagtaggtgcttggccaagggtggcagggccatgttcaatacacagatttcctctatgagactttgcggggaggacagagagcttgccagcagcctggcctcttgtcccgtgccctaggccctttggagggagcccctgccctgaccctggggcctccctacctcttgcactattgcctggccttctatagccagcccctcacacctcccaagctgtggtcacgtggaggccctgccactcacgggccatacctgccatgtcctcggagccttaagatgcaggtgttgagagctcggtgttgcctgtaaaggtccccctggaggggtccctcccatcaggcctggaggctcgggtctgtatacatgcatctgcatggggcatgactggtttccagaacctcagagcccaatccacctgcccacatagcccataccagctgaccaatgacagtgaggcgaatcaccagtctcctcctcactctgaggcctccctgcgctgaccctgtcctcaacttttgatttctccttcttacagcccagctcccacattggactcagttctgtgatttgggatctggccttgacctccaacttgccccagattgtgccttggacttggcccagtccatgctcaggtgggccacccagagccactttgggcctctcagagcttatttcctttggtgtttggtgctgtggacagagaatagtctggcggagaggggagctgagacatgcaggatgctggtgcctggaatggctggcactgagcccatcgctgcctggaaccactggctgcctcctctctgtggcttgtctttgccatagtctgtgagcttggggcccacaccccgtggagcaccatggccagacccaggcagcaaaggtgaggttggcccacagggaaacctgtggaaggctctggcccccaccccatcccaggctcaccctgcctcacagaaagcacaggagacccctggcactggggctggagcccaggacacctctcccaacttcctctggattatgaaatatatttcatgtgatatctcaattcttttcaaacaacatggagtgacatctgcagggcactttcctaatgctaaacaccttgggtcagcagtagaaatgcctccagtcattggggtggctcctaatcttcagatgtcaggcgccagggaacccaacttagggactaagatcctcacttgggaagggtcctgggggccatcagagggatggccatcactcacaggtgagcgagtgtgcacatctggattcatttccacgactcaggatcacatcaggcagcatcaggggccccaggagggatggaggtcacaggctcccaccctcgtcttagccctggaaacatgaaggcctccagtgccctcctccagtaaccccgtgagtgcctggcacaacagtgggcactcagtgaatgccggtaagtgcctgttgaccagagctcatatgggggagtgcacctctctggcaagctggatcccatcagtgtcggcccacatgtgcaccagcctcgtttcagctgggagaatcgcatcaggacaatgggaaagcttctccccgttcccctgccaggtgggcccaacgccagagccgcgatccagggcatcgctgctaagtttccaggctcccgtcaggcatcactcccacccagggggaccctgcactgtctcacttctttagagacagatcaaattggagagagttggctcacatcaaagacaaggcctatgttgtttacacacatttttttgggaagagggaacaaattattttccttcttgtccatgggatgccaatgatgagttctggagaaccactcagagacacctgtcatgaattcccagggcagggttagtggagatggagcaaacagcccacagcgcaggctcctgatttagaagggaaagtgcagcatggattctctaaagtccagcagcagcagcttgcaggagacactgcggcactcatggtgccctgaaagttgcacgggatggaggccacaggggacgatgcatgctgatgacatggcaggaagggcaggtcttgactcagcccaagggagcttctacccggggccgccgtcctgcacttctgagcatattcatcagggacaaggggagaggcaggctcatggccctagggtctgggtccccctgacacacccacacagtggtggagccttgaggacagcctggggcctgctgcaggtgtcccagggaagagggcatgggggatctgtgcctgcccacattggaatgcctcccccatgggaagcactgcaggctgggcaactctgggggaaatcaccaggagcctgcacagaggccccgcccaatgcactggagcatgaagcaaggagcgtctgcctgccctaagggcaccccatctggagagagtgactatggcactggccatcctgtcagccgggagcctcagggaacaaaggcagagagagcccccagaggagatggcagctcaggtgagcctcaagtgatcacctgcaaggaggggatttccacagaggggcgtgagtcgacggtgggatgcagcttcttttattcatttatttatttatttgtttggccaaaaagaagaaagaaaaagtcccactcatctttaccatccagatcacattgggcagaggttcaaggaacctgcgtgtggcaccctgggtggaagaacgctctggtcccgacagcagtctccctctgctgaggccttccctgactccccaacacccgctccccatttcccttcccttctctccctgctctgcagcctgatcatcacagacgtagtgtgggctccacccatttttggagaccgtcagcccttccatggcagcaccttgctttcaccgggctcccagtcttgagctctgccctgagtgcctcccatgcacagtgctcattcattttggttcattcagcaccttcccattttacaggtagagaaacataggcccagagaggctaagtgacttgtccaaagcaaccagctggcgcatggcagagcaaggactccatccaggcttcctgaatctgcatagttaacccctgggccatagaatctaaaatggtaacattatctaaggtctgggatttttgcagttgcaatgttcccagagccgaaaacagtgggtggcacataatgagatcttcataaatgtttgtgaaatgaatgtagacccagccctcctgacactgaatctgcaaccccccaacacacatgcattacagtgagagaaatttgtcatcttggatgcactgaaccacatggcatttcagctcagggtccccactgtctgtgtcggaagcctctggggcctgggaaagcagcacaccccataccctcgagtaagggtaaactaccaggaagcaatgtcgggtgcagagagcatggcctttggagcatctgctggagtcattttcctgaccctttgtccttctgcccacagttctctccccttctcagcacagcatggaggtcagaggccgccgtagaagcctcattgaagagaagacagtctgtactagaaactcaaggattagaactgaggttgaatcccactttcgcacttggaagctgtgtgatcttgagcaggtgttccaacctctctgagctccagatacctctggattgacaaggtcagggtttctccctgagaagtaattttctaacaccttgacatacacactctcctggcctgtgtcctggaccactgggccagtttcaacccctctgctggagacagcagcaaggtccctggacgatccctatgttcgaagtctgcttgccactgcctccaacagcctgtctgccattccccaggcctcagtgctattctgtggtgagcacagaagtgtccttgcccagtctcagtttttatttattttttattgtcagcctcagttcctaaaatcttaccacgttattagaggaaggtatatttttgacaactttatccacagttaccttaaatcaaggtgtcatatacacagtgccaagactgaagatgtttttcaacataaaaatccattttgttgatgcaaaggctgttgagaatcccttttgaaatttcatcagccagtactcagaagacttttggatttgactaacacagaggaatctcttcttggtaaaggacctcagatccagatgttgttccaatggaaaaaaaaaaaaaaggaagaagaagaagaaaaagaactttttccaacattcctttataaggaagctggtgctggggatatgatgtccactttactgggacaaaccaaaatatcttgataagtagaaaattttttttagcaaataacctgctgttggaaattttttaaaaaataaacacagtcctataatctatgtcaagttcagtggtaaacatgaataaaaagaacttaaagaacttaaagagtcaagcgtcatctgggtaccagtaaactcaatgtaagtggtgattcagcaagtgagcttaggtttttaaaatgtactttcaatttttttgttaacaagaaatgagttaacttattaataaaatccaaataaaatgtaaaatgtagtaaggttggcacaaaataattcccatgcatgtgaagtctgcacctgtttatctggggggactataatcttgcagaaacttgaaacatcctgacatctttagtatcttgctctgcaaattgggaattacagcacctacctctcagagttgtttgttcacttcccctgccccacattccaggtgaacccccgacagtgggtgcttgcttccccaagccagaatttaggtccaggtgtgtgggtccttacggcacatcctaagtgacagcatgcaggttctgcctctgaagacagcccttccctccttccctttctccctccctttactccacacctccgcatgagcatctagtgggcacaggccaggggcaatgctctaggacttggtgatacaacagtgagcaaaatctctgtcctcacagcgcttaccatgtagaacaagaagaaagatgctcaaggaacacacagatgtctaaagtttaatgcaaataacataaaagccaagataactgagtcccaggctgttccacccttcccccttttaaaacaatcccctctgctttgcatgcaggcttctctccttctaccctagcccaggtgagggcattcagagagctccagggggcatcaaatggaaggggtggctcaaggtctcaccagcttgcagcctcagcggagagcagtcactgcccctgtccagagtccgagcaagctaagcaggcttgggtctgatcagcatccaccaacaacgagggcatgagggagggcgagtgtgcagagggacaggccacacttcttccaatcccatgcgtggaggcaggcaggtgccctgctgtggctgtggggcaggactcaggggatggaccagctccaggaatgggtatggaacagattcacatggcccaggtcagattcatgtcacagcctggtgggcagcttgaccatgccagcaccagagcacaggccctgccatggaggctggaacctgtgggctgggctgccaggctttgggcttgcggagcaacacacctgccactcaggatggggttttgtctacggcgctgccttgtggacagtgagattggatgggggagcagcagagcagtcaggaatgatgaggacacggggtggtcctcaagcctggtccatctgctacggcaagcctagtttgggacttaaggtggctgcaccattgtagtggttattacgtgggttttcagaaccagtcttcggatcaaatcccactcctgctccttctcagctgggtgaccttcagcaaggcttcctcatctgtaacttggcaacagtgacaggtgccttgcaaagctgtcttaagaattgatgagatggtgaaatccaaacctcaagctaaagcaagtggggagaaaatggtcactgctgtgaacagacatatcagcagcagctgtggtgcatggcagagccgtcccccctgcagcatcattccacgaggcgtggctgggtaggccttgcggggccagcacattctcaccctgcccacctaccaaggcctgtttgtgttaatgtcacagctctgaagcattatcatcagaggccatgagatttcaaaggagcttcctttgcagagccacattgctctgtccataattagcacaagtttccatgagcatgacgatgaggccagaggggctgccctgcaggctggtttgttagtgtaagacattcctggggcatctgcgtagcctgggctatgcttttccagccctcgctccccctggcccctgccctcagcagcccccaggccctcattaagggattagcgatatgggccatgcaatcccttggccatctgcttgagaagtgctgggttctttgctctgtcccgcctgaaccttatcagtggtcctcgcgcaatgtttgtgttgcaaaaatcaaagcaggtcttgggcggaaattatagaccactggtgtcatgagctaattaaagactacggggtcatacacaagggagaggacacagatttctcccactgtctgtccttctgctaatgggacattgacaagcacagaccaggaagaaggctgagaaagccagcagcccgtgagagtatgataaaaggtgacagtgacaggtcttgcttcaccaagtacagattgggggatgctcctatcagggcccagcacccgtcacaaagggtgtggctgtggggcctggcggcaggctaggggcactcccccagcagccatccagagcctgagggaggggatctgtggggggacagtctcatattaatggcaacacatttatgacccaggaggaagtttaggacagttctgaatgtctacatctccatcatcaaaacagattaaaattcaagaataatcttgaacaatggaaaatagacaggcagggaaaaaccaaaatgtaaccttgaatagcttctgctgttgttctctgtttaccaggaggctgtgagcttcttgaagggtttggctcccccacatgcgaggtcggggactggggtgatctaagtgagtgatgggagctcaaacccttgcacatgggatgagataacatccctaggtaccatttgaatgctctctccccctccacactcaccccagttcccagccccaggcagatggaccagactccaccgctgaatctaaagtaaaggcggcaaatgtacgaccactagggtcaatatctggtgacttaggtcctgatgagagtgcttgccatgattcctgcacagagggtgatcctgtactagaggactggctccaaagcttccaccggccagggaaggggtcacaggagcacatcaccacccaagcaagtgtgatccctgccaggactagcagtgctgcagtagccttgcccactctcctgcggtcaggacccctcagtgatggcacacgtcatccagtttggaaagatcatccagcctcaagactgggcagcacctcccactcaatgcacccatgtggccagcccactctaggggtccgggacacgcttctgtctgggtgcgggggtattcgaggggggactgccatgtctgtcagggagtgtgggaagcagatgctgtaaggtgcaaaccagtaattttctggggacaccttctgagcccctcccccttccttcagccattctccatgcccccttttgctgagcataatcctcaatttctttattactcaatccagccttctctggcagaggagtatctactattttccaggggaggcttctcaaaccaaggcctgcaggcgaaatccagcctgctatctatttttatcaatgaagttttattggaatgcagccaggttgatctgtttatgcactgcctatggctgctttcaggctatgatggcagagttgagtggttgcatcagagaccctacggcctgaaagcctaaaatatttactctctgactctttatagagaaaatttactgtctcctattctaggaggtatagaaaaactattttagtttagcctcataatgtccctgggcaatagacgttgattttcatttgaaggaaagccaccaaggcttggcaaagttaaatagaacccagctgttagggaagggaggtgggcctcaaagccacatgtactaactctaaagactgtctttttggcatttgtcttgttgcatctttggcagaataagccgagggtgaaatgttgccttgatcctgttgctggagcagggctagagcttttacacctcccaaacctgcaggatgtctagtaacagcccccaacttttctccatggaagtcccggttaaaatccaaagacaaatgaccctctccatattatcctccaagatccaaaattactcattcaaacagctctttcctcttctccttaggtttgtgacataaaagtgtatccaccagtgagcctcttcctcctccctttgatccaggcattgtgtgtgcatttggagcctgagccaggtgggtaaggtgaccctggatgccgcacgaggtcctttttgggactggcaggtgcctcttcactgggcagtggagacgcaggatgagggagttgatttgtggctatagagaagctgtcagagacagaacctctggttactcagtgatggccctccgggagtcaggaacccaacagacctcatctttagtctgtaggatcccccagaaagcagacgcgctgggcattagagtgcctcttgttctctctattggctgtcaagcctctgaacgcccttagtgcttgaagaactggccccagcatggatgagtcctgcaggattcaggacctagctgctgctacagacacggagcagggcagtccagactcagccatctttctgctgctgcacccacctacttgttacctgaactctgccacccagcagtaagctctgccaggcctcacagtggggtggtggggtgtggcccacacctcgccaccacccacccccacctccaggttgacctcggtggtcaagcttgccttgataccttcctgttctccaagcctgtgctccaggattctctgtcaaccaccccatctgttcaataaattcattttctactaaagtcagcccacacctgtgcagaaacagggttggagcaatttaggtgccttgtccaaagtgataacagatgggaaaaggcagagctgggattcaagcgcatctcctctgaccctaacaagcacaggctgctctcgctagccacacccctctcaaggagcagcactgctctttctagaccctcagaaatgggccacctcccagatgccaggtgtgagtgtcctgacacctgcccctcactctcctccccagccagggcttctctgatgaattttcccaagtcagcctcttgaactacctgccttcctgggaaacaccttcaaatctgcagaggaccaagtgggctccagaaatgaaagtggagcatttcactgtgtgtggagcagtgagaaagggagagggtaggcttggagagtgcagttagcctgcattgggcatcctgacccgtcgggccccaagatgggagggcacaggagcctccagtcacaggaggtccttggggggacaatgcccaaggcctagttgaggaagggggcagagagccggctcccagcacacctgccaggccccacacctgggaccttggggtcccagagatttcttttcaatgcctaaagctttgctctccgagcctaaggacaagtgggcaggacagggcaggatggcatagacttgacctccttccccttgtcccaagttgcactctccagacatgggctggctgcacacatgggctggacactcagggggaaggtcagacttcccaatctgggaccctgattttgctgttcatggccaggtgtctgtcccttggctgtcagctgtgttcaccaggtgtgtgtcccctcagaaggtaagtggctcttccagtgggagtgttgggagaaggaaggagaagagcattctgcaggcatccgccctgctgcaactgcgtgtggctgagtgccccacactctgtgcccagggccacctgtctcccattatggctgaatgtgctaatagggagattccagaccttagttcccctggtagtaaaggtgaccctgcagctccatctcaggggtgtggctccctgaggcagtctttcacccatgagagacttgcccaagatcaagacagcagaacactgaagctgagctgcccctccaacccagctctcgccgaccccaggaatcagggggctccccacttatttcctcctgtgttccagggctaaacattcggctttacacacacacttacctgcatttaacacctccagtcatcagccctgcttgaatcaagttgcctatgtgccagggaagtggtggaggtgaccgctcctgaccacagtcacctggccccactgggcaggagcatctcctggccgggagcagtgagggtgggaaagtcattttctcaagcattggatgggggctggaggggagcagacatgctctgtggtgggctttgggaacacagattccttgttctgggtgagcggtcatgaggcaatccccatttcctcatctataaaatggaaaaagaacctgagaatgctggcctcatgacctcattgtgcggcacacacagggaggatcagtcctgtggtgggtgctgccccaccagggcaggtgctccggcagtgacggggctcgtccacagctgtggcaaccccgatgcccccaccttatctggtagtcattgtcatctgcatcctccctgtcattaacctccccatgccccatgccctcccttttacatcctggccaggctgtctgtgccagctcaccagcagcccatgaaaagcctggacaatgattggagagaacagtaatgaatacaaatcattctctgggcaccacagagcctatcttgggtgatgcagcctctgggtgctaaccatccttggtccttcctggaatggctgtcaggccactgaggccgcaggcttgatgaagatggatgatggcctgtgcctgggtaatgctgtactaacacagagcccagcgtttaatcagagctctgctctctgccagagccgagtaattggaggcaggtgctaagcacaattgaaataaaatgtggagttaataaggacagttgacaaggatgttacaagtcccctgtccaagttttcaacaggaattggaaggcaacttggagacctcagaaactgtgagttaatttccaacgtttctcttcaaaaacaagtacaatcaactttagggctttttttaaagcttatttattttcatatttgcaattcaaaaataagatggtcagaaaagcagcacatgtctaagatacttctgatgtactacaggggacaccagctccatggaggcctggacacccctcttcccaccttcatgctccgcactcagcaccagagtcctccaatctgcctctctggctgtcccttcctctcccagcccattcttaatggcctctgcatccctcatcttgtatcatccaggccattgctaccagcgcagtcttgctagaatgcacaactccctgcagaaagttctattccctcccaagtagagctaagccccaagtctccatggcctggcccgagctgggcccagccttatctcccactgctcctgttcccttttgctgctctagtcatggtgaaaatcctccacctgcctggagggtccctgccacctccactcttaatacactctctccctggcctgaaggatcttccgcccttcttcattgacattcccagatagtgccccaagagctgtcctgagccccgcgcctacttcctgtgcccacccatcccacggacagcactgtccatcacatcacaccctccacaggctgctgccagtgtcctgtctcccaacccgctagactctgcggtgcccaggtcagactgtgacacctgcaggactgcaccccgcatggcgcctgcaccccacgaggcatcagggatgcactggaccagcccaaggctgtccttgtatcatgtgctatcacttactagccagcacgttccctcaaagctgcatgggtgacattgacatggtctgtgcccaccctcttcatcctcaaaacagtcccagtttatgatttcatttcataaatgactgcccccccccaccaactaagaactggaaccgtaagaggcagatgaatgaaaggaaaacagatttaagcctgaaatcctccccacccagccagcaagctgtctcgagtgccctctcggctcagtcttcagtgaagtgacacctggtgaggatgggctgtggattgtccccctcaccagctaatacacctggattacacagtcacctggagaatgagcctcagggtgacccacctccatgtcaaggggaatcttgaggtccatgagacccagctcctatgtgaggggacccacctccgtgtcaaggggactcttgaggtccatgagacccagctcctatgtgaggggaccattccgcattatccccaaagttggagtgcatggagctaccatatgatccagcaaccctactgctgggtctatactcaaaagaaggaaaatcagtttatcaaagtgatatctgcacccccatgtttattgctgcagtattcacaacagccaacatgtggtcactgagcttgactgatgctcagtgtccatcaataactgaatggataaagaaatgagtgaacaatggaatattattcatccgtaaaaaagaatggaattctgtcattcatggccacatggatgagcctggaggacatcatgataagtgcaataagccaagcacagaaggacaaatatcgcatgtcctcactcatatgtggaagcttaaaaagtgggtctcatgaagatagagagtgggttggtggtcaccagggaccaggaaggttagggagagcaaaggataaagaggggttgattgatgggtacaaatatacagttagataaaagaaacaagacctcatgttcagtagatcaatagggtgacaatagttaaaaaaaaatctattgtacacttcaaagtaactagaagagaataattagaatgtttctagcataaagaaaagacaaatgtttaaggtgatgagaatcccaattaccttgatttaatctacacattatatgaatatttcaaattatcacacatacccctaaaatatgttcaactattatgtctcaataaaaaaaagttggagtccaacttcccccaagacaccccaggaaggggttttgtgatgagcaacagctcagagatcagaaagccccctctaagtcttgctgacatcctcctgtctctgtcggggagctacagagccactctggaagcaaatgctcccttccccacccctcaaatggagcagtcccttctggacatggttccaggcccatctttttcctgctcagccacagcacctcttcagaggacctcggtggggtctgcgcagcaccgaggaggcttcactccattcgggcagttctgcctctatggaagacagtggctcagagagtcagagaatgccctctggaatcttctgtggctctgactcacacccagccaaggccttccctctccccacccaagtctgaccatgtgaggagctttgcacacaatgtccctgattctcttgcatccttgtcctcaagccagagtggactcagcgaagtgcaatgatctgagggctgtgcttactcgaggcccacctgggcctgctgtctgctcctccctgctgctcccaggggagtccccccacttccccaacatccccagccccgtctcccctggctccaggctccattgcaatctgaaagctctacaggcagctcaaactcaggtcccaaatggaactcattatggatccctccaaactcactcctcctccatcccctgctccaaagaatgacatcaccaccagccggtccccacgccagaaacctgggaatcatttgaggtgtctctggccctcatctccacccctagcaatcagtcagcattgcggctgcactggcctgaggtttcctgagcccagcccactcccttgcccactgtcattccctggctcaggctctcatcttttgccaaggctgttaccgcaccagcgccctcactgtctttctgattctaagctggctccctgccagtccttccctagcacaggtctcaagatgatctttataaaggtccaacatggtgtgtcattccagctctaaatccctcaagggctccccctacatttcaagaactcaaatgtcttgacacagcaagggagaaccacgtgacctggctcaggcctgctccccgacctgggagcctttctcttctgcacattcaacactgcttttttctcactttgacccttgtatttggactcccttgtcctccatcctcatccctgggcagtggctctcaaacctaagtgtgcatcgaaatcactgtaggggcttgttcaggcacatacaacactgggatcccctcagggtttctgataggtgagtttggggtggagcctgagaatctgcatttccaatgtcaagttcatatgatggtgatgctgctaacctgatggccacactttgagagacagcaccaccactaaaaccttcaataagcgctcgaaaggacccaaaaatgctagccgaatgaatgaatgaatgaatgaatgagtgggatacactctggccagccaaagttttgcagccactcgttaggactctgttgactggatctcacgtatgtgagtaatcttgggtggaatttctgaataagttaaaaaagacaaagctacatgttgcttttatcagggttgggggacccctgtgagtttctcttcgaggtcaggtcctgctgtgcgccctaagggtcagcatctttcccagacacggaggtgggaattggagggcctgggcctgggacctctgaatgcattcccgttacatcatttggatttctttatagactggagagtttacaacatcatcaaaacacatgtttttgtgattttccaacagccttgattcctgctaccatgtcctgttcccaggccaccactgagcacagcagacagatgccagcaagcatctgagctctcaaatgcacacagcatgtcccttctcgtgggcggggagctttggaaaatggaacactgggtgtgaaagacccagaaagggccctgtgaggctgcagagaaggggtgagggtgaggccagcctgcccagccagaccgtaactgtggagactccgtgagtttccagagtcgtgattagcatgaagaagcccctggggcccagcacagccatgatgaccagcacagtccgctgcatcagccaccgagggcctgggccctgtggaactcgccggggtagtgctcatgatcctgcttctcagtgtatctggactaggaaaccccatggtggtcaggacatccaggggagctgacggtctgtggccacatcactctccccttcaggcccaccaggctgaaagggcaaattccaaccctccttcagaaagggagttctccccgagtccttgagatccactgctctcttggggctaaactgtgttaacgaaaaattcagatgttgaagtctcaacccccagtacctctgaatgtgactgtatttgaagatagagtctttaaagacatgactgagttaaaatgaaatcattaggatgggccctaatccagtatgactggtgtctgtgtaagaagaggagacaaggacacagacactcagagggaggaccatgtgaggacatggcagaaggcggcgtctgcaaggcagggagagaggcctcaggagaacccagccctgccgacaccctgatcttggacttctagccctgtgggaactatatgggaaaccgtgggaaaacgactttctgtagttaagccccctagtctgtgattctttgtttctgaagctcaagccgactaagacagactctccagagccctggccaatgcgggcctctctgctgggtgaggaactaagcttagcgtgcctcatgaaggggttcaggggtgtccctgaggcctgtgcccattgcctgctctgtcttccccctggagagggcccttcagctctgtctgccctgggcatctcaatcccaccctggcttcccatccccacagggtgaactgcttgaaatgcagatgtgctcactgagaaagaggggcttgagccaggtttccaggcaatcctcacttgactgagccccagacggcagcactttgggccccatcccccaggcacggcctattcccctggggctgcacagaggctgtggggctgttacctggagctgaccttcggtgccatacagcccttttctctctggcctgagcattagccctctccccaaggcggtcctgcctcctacccccagaggggtgtgcttccctttaatttcctgcttcttccgtgaggatctggaagccaccttgcctctgggtgggacctgaactacacacctatagctggagatgctgccatggagcggagaaggaaggaggtgagctaagagaaggggtgggtgacaattctcttgacaccaactggggacccacaattcaattcatttctaacacaactgcctggagctagcacagaccccacaagctagggactctgccctgcaagactgcacccacttcaagatgccagccacaaatctcaggggccccaggccacctgcacttctgcctggcagagtacacatttgggggctcccacagaccgcccccttgataatttgctagaacaactcacaaaactcagaaaagagctgtccctactattacagtttatgataaaggctacagatagatggccacatgaagaggtccttggggccagatctggggcagggcccatgccctccgggctccccttccagcacacccatgtgtttcagcatcagaaagctccctgagccgcccgttccaggggctttgttggggtttcattacacagacataatggatgcaatcgctggccatgtgacggaacgcaatcttcagcccctgtgcctccctggaggtcagaggtgggcagggccgaaagcatccgtcctgtaatcaagtgcttgggctctctgatgcccttccctgccttatcccactcaggtgtggagaactctggtgagggccctcctctgggatacagaccactggcttctctcagcattttcatgtggcagaaagtgggtaagaaatattctgggggtcccttttataaggcactaaacccattccagcgggctccaccttcatgacctaaatcacctcccaaaggccccaatcctaatcccattaccctagggattaagatttcggcatacgaatttggggggacataaacattccatccattttctctcccctctctcctgagtgaccccatagggttactgggtgagggtaccactctcggtctgcaggccccactcctcctcccactgccgaaggtgtctagacccaaaggaggagaccctgccccgagtcatgctgctcccatactgccaccaggctgctgggatgctgggtggggggctgcagaggcaggtgggggccccgagagtggtgttagggcaccctgcccgatcttctaagtgacaggagagtggggcaggggtggcgcccatgaagaaaggctgttttgctgtccacgtggagagtcatacaggggatcacagtgtacagccttgggaaagctctcactaaatagtccttgaatggaactgggggggcctgaagcaggtgggttaaggggagcctccatgtgtctgagacctaagagcaggactaacttggtgaccagccggctgggtaggcagagcaagggcttcaggcttctgtctgggctgtgagagaccttgtggatgcagggtaggggggcaggaaagagtgtggagtggcagcttcattgcagacgtgctgaagatgaggacacgggagcctgggcaggggtagccatcagacatgaggacacctatgtctgaaactcagaagtcagggcaagaggcacagatttggggctagccatgccatggctgctggggagggcatgctggggctgtgatggagaagtctcctgtacagccctgtccctgacctcccacccctggctctctccctctccccagggcacagcttcccaggaaagaaaagccaatcccatgaaacattggtggtgcaagcctggcagcatctgtaacgctctcactgtgctgttccttgttgggactaagacagccgcaccagcaggcttctccaaggactgggcgaggctgccctgtgaagcacatggcccacaggtccgtgcacccctctgccacgccctggctggggtgggcactggttatcccttccccattggcctcaggatccgggttgcctggcttgtggagacttgtgccatgctcttctgattagccaactgtggaggcttccagaagtgcagggcgacaagcctgtcccactgggccccatcaaaccccccaagtgcttcccttcccactccaatacctctgcatctgaagctccatctgaggctgggaggctcctggcttcttcctagggctctggcatgcctcaccttggcagaacaccctcaaaatgtgaacacaagtgtgttggggtactgacgcagtcgatggggagaacctggcaggtgtggcatcaggctggcagcttctgaccagccccatgacccctgggtggccaccattcccttctctgcaaagaaagaggccatgagtgaccccctcctctggtggggtgaagcttcgaggagatgggacccttgtctgcctggcgcccagcttccactggcaccagtgggcattcagtgcaggaatcccctctgccctccccctccccacccctcctatccaagttgacatcctcactccggtccctgtggggtactcagaaggaaggcccaaggctgggcagagggctcactggatagcccaggagcccaactccccactttctccacccaccaacaccttgtgggcgagcgccccccagagcccaagggcccagggcagcagcccgtcctggaaactgctgtgaggcctggttgtgcactcaggggcagtggccgggctcctggcttccggcagagtcccgctgggaactccaagaagggaatggtgagtgggaggccctgaccttcttcatgtgtgtggatggaggcagctggaccccatgaggagctcaggtcacaggggctgggccctgggagtgaggggtcagggaggccagagccagtatgtgctggttgcaggtccaatcctgtcaaatcctcaccttcttcacgggaggggaggcggtcactctcatgaaccctattttacagaagatgaaacaggctcgaggagggttagtaccctaggctcacacagctgggggcagagctgggattaaaccaggttggatggggccagggaccctgagtgaatgcaccacccacgctgccctgcagaaccatgtggagatgggcacagtgaccggaggtggccttgggggtcgatgacatttgcaggcaatagtgtagctctggctctctgtagtatttcctgcagggaggcagagggcagatggggtctctgcctcatgatcctgcagggaatctgccgtcagcgctggagcacctgtgggcacttgatcctatccagctgtagcagttgtcatccccaggaggggccagagtggcagacagacctccgtgcccctcttcaggaagctaagggtgactggagctcacaggcctccacccagcctggactcctctctcccaggcttctgggagtcatcccagaggaggtggggcccagagtccatcctgtccaaagaccacagacttggattcctgcaagggccaggaaggatgagtaaagagctgaggatggggcctggtggaggctctggccacccaacaagcaccagcctctaagaaaggcacagccactgactgtgcatctgtgggctaccaggctacagcctcatgtggacagggtcggatgagcccctgttcacacaggtctgggctagcaaagtcctacagccaccctgccgcaccacacaggggagggagcaaaggcccccgactgcagaagccccaccccatctggcttcagtcttctctctgtctctggtcctgaggccctcacacgttccctgctctgttcccaacacaccctcctccaccagactgcctctgagagcagggcacaggcagcaggctatgcaagtgagaggctgtggagttaggcctggctcgctccacctccctgctgtgtgaccctgggcaggtgcttaacctctctgagcttcagtgttgtcacttgacaggtggttgtgaagatccaaagcaataatgtgtgtcaagtgctttgcatgcagcagatgaagccttcctttcctccctgaaattaacaagtgcagtgctgggaagtgggagtcaggcataatattaagtccatgctcaaataggttgtgggtctgatggcagaggtttccagctggggctcatctgttagccatgaacttctgacccagaacagaggaggagacacaggttcagcagctgagcgtgtgagttggggagtcaggggatcctgcttcccagtacctgcctctggcagggtcctgattgccgcgcaggtgggcaacgccacctagtgggcatgcatagtgccatgactcagggtattgattgtcctcacacacgcgcacatacacatgcacagagctgtgaacacacacctcaggcccctacccacaccttcacccgcacacaaacgtcttctagcttcttaccccttggatcctatcttggagctgagcatcagcagccataaaaccatgcatccttcctctttccaaaagccaatttggggattgtgtgaggacagccaggtagtctgaaatggaaagggggtgaggtcacatttgctaagggcatgatagtgcatgccaggctccaagccatgagggaggtgtcaccgtagcactgaaaggttaagagcttgcccaagcccacccagagaacacaagactgcaagccccaggctgtgcagctgtacggcctggttcctacaagctccacaaactattccttcataaaaaagggtttttctggatcctttaacttccttcttgaactagattttatttgaaatggaatcaacttgactcataattctatttagggtcccgagatgattttctaagtgacagcagaacctgcattctcagcagccattgtctaacctatgctgtcctcctcctccttctcctcccagcaacggtgtgtgtgtgtgactgtgtggtttgtgtgtgcacaaatgtgtgtgtgtggttgtgtgtgtatatgtggtgtgtgtggtgatgtatggtgtgattgtgtgtggtgatgtatggtgtgatgtgtgtgtgtggtgtgtagtgtgtgtggtgtgtgtgatgtgtgtggtatagtgtgtggtatagtgtgtgtggtgtgtgtgtgtggagtgtggagtacttgtggaatgaatgtgtggtgtgtgtttgtggtatatgtgcggtgtgtgtggtgtggtgtgcatgtgtggtgtgtgtaatatgtggtgtttgtggtgtggagtgtgtgtggtgtgtggagtgtgtggagtgtgaagtgtgcatggtgtgtatggcatgatgtgtatgtgtgcatggtgtgtatggcatggtgtgtacatgtacatggtatgtgtgatgtgtggtgagatgtgtgtgttatatgtggtgtgccgtgcatgtgtgagtgtgtgtaatgtgtgatgtgtgtggtgtgatgtgtgtatgcggactgtgggtagtgtgtggtgtgcatgtgtgtggtgtgtgtgatgtatgtgtgtgttgtggtgtgcatgtgtgtggtgggtgtggtgggtgtaatgtgtggtgtgtgtggcaagtatgtggtgtgtgtgtggtgtggtgtatgtgatgtgtgtgtaatgtgtggtatgtgtggtgtgtggtatgcatgtgtgtggcgtgcatgtggtgtgtgtgtggtgggtgtggagtgtgtggtgtatgtgtgtggtgtgctgtgcatgcctggtgtgtgtaatgtgtggtgtgtgatgtgtgtggtgcatgtcatgtgttgtttggagtatgtggtgtgttggtggagtgtgtggtgtggggtgtgtggagtgtatggtgtgtatgtgtgtggtgtgctgtacatggtggtgtgtgtaatgtgtggtgtgtggtgtgtaatgtgtggtgtgtgtggtatgagtgtgtttgtggtgagtggggttcgcggcaccaacaggcgctcagagtgtggttaaacccctgctctgcaccagatgtcctgggtgtgttcctgtggaacccgtgcctggactgcaggctgctcctggtgccttgtttctaatgaacagaacaaggcagaagtcatcggccaccacttccaagattagattacaaaaaaaaaacctcgggttctgccctgggtgcctcctgcctgctcccttgcctgtttcagggaaagccggtggccaggctgtggcctggagaggaccacgcagcagagaactgagcctggcctcagccaacagtcagcaagtgatctgccagcaactgcctgagtgtgcttggaagcagagcctccgagtgaagagagcgtgtgggacgccctgaggcagaagacccagcgaagccaccccaatccctgccccataggaaccgtgcgaggataactgttgttggaagccaccaaagggagggcagtttgtcacaccgccacagagaactaactcaatggaccttttctgtccccttctgagccccacactccctgctataaagtagggattgggtcacaggtcatgcttgcttaacacggtgcttgggaccaaagagagactcaacaaaagttccctttttcctgtccacactcagaggcaggcttggatcctgctcacccagcctcatgtgatgaaaaactccaagtcaggctccgtcccacagctggggtctgacaaacagcacccccttgccagccacggcagctggagaaggaggtcgccagcagcagggctggagagcagatctgatggcatcagctcgggcttgctccgtccatgccgggctggagtgtggccatcactcccagccacagaagctcgttgatctctgacctccctggtgggaacaggcccttctccaggacaggccagggcacctgcactcagacagtctgcgggtgctccctaggccagggctgacagccccgatggaaagctgatgccctgcctttggcacagtgagtccaggaagaggcacctagccaccacccacatctatgggagacacacctagccagctcctgattccctagcctcactccaggcacctcctaacactccttccatcttcctaaggggcaagaggcagcctcccaccccaacaacgctggctgctgcccaggctagcccagtgagctccatctgcagtcccatggcgtggatcccaggaccctgactcctgggagtgggccctgggaggagtttcagagctgctgtctcccaggggaggctggccaagcccctcttctcctgctctccctcccgtcaggcacagcagccccctgctctgggaaagtacaaagacctcacctctgagacccctccaccttcgaagctctaaaaccaggattctcgcatgagccaccctaacagcaaccctgataagatgttcttcctactttctagatgacgaaagtcagactctaaggctcaagagtttttggcaaggtcacacagcaagggtggcagtcttaaacgtggccccagaatcccttgactttccttccactgaggggtggggtttatgccctgtctttgagcctaggctctgtggctgcttggccaaagaaacactgtggacatgatgctgggccagtttctgggctcaggctgtaagaaacctgggttctcttggaacccaatcatccttctccgagggtgcccaagtggcccaaggagaagaacctggcttggccccctgctggcagccatgcggtgtgccatcttgaaagcggaccctccaccccaccttgagttgcccaggtgatgccacggggaaccatccccatgaagcccgacccacactacaatgtcatgagctaaataaatgtgtttttctaaaccgctaggtttcagggtaattttaagtaactgatacagcaagaagtgatgaacacagttcagatgatctccaagtccacagtctttttgattcccaaccatggctgcctccctgattctcactgtattagtctgaagagcttattaggggaggaacagaggccttgaaaagacccccaaactgaaatccccttccccccagggacagccccctccaggaaattcctttcagggctgtcctcgctgcatttcatctctagccctgcggcaggggtagaattcttagatgacccctaatgacttttgtcttttttataattttcctcgagtgagtaaatgtgagtatgaaaatctatcactctcaagattatgttacttatttcgtgcaaagactttgcaaatgttatgaaggttactagtcagtcagttggccttaaggagatattttctgcttgggtctaacctaatcacaggagacctttaagagtagaacattttttttctggtggtgggagatgaggtagtcagagagatttgatgcttaaaggggcttgtacactagggaggttctcctctcctgagacggaggggccatggggccaggtcctgagaggagcctctaggagctggggtggtccttagatatcagccagcaagaaagtgaggacctcagtccaacaaccacaaggacatgaattctgcccacaatctgaatgagcttggaaacaatttttcccccaaattgtccagaaaagaatgcagtcctaccaacaactcaatttcacttgtgggattctgggtggacaacccagttgagcccaccgggacctctgacttacagaaccatgagataaatgagttaagttgctaactttgtaatttgttacataggaataacaaaattaatatgatcccgttctttttgtttccagactcttccttctccaaaagtgtccttcctttttttcattgcagaccttgtaaatggggtgacatgtagatctttaagccgtggctggagcgtgggtctacagccttggccaaggcccctgggccagaccttgggagtagtgtttccacccatagctgagggctgagtgtgggcccacagtggaatgcctgagcgtgcactagctgggcctccatggcctggcagagccttcctgggctggaccggctgagtttctgagtccaggggatgccgccaatgatcaggctcccagacttcctgttagggtgactaagcccagccttaattaggtggactctgatgatctgttctctctcaatttcctcatttctaggacaataatggttctctgttcataccagaatttcctcctaaagaaccagccccagactcttcacaccatttattcagtcttctccctgtgtaaccccagcctttcccatctctttccttttctgaaacccagccacactcttacagcgcacgcttacactgctgtacaggtggggctgagtgtgcctgacgccccttcacctcctctcctcaccccagttcttggccacactctagaacgcagataacacaggagttcccatgtccatctttgaaatgagaagcctgaggcccagagccctcagcacggaatggaaggctttgaatgcaaacctagagggttcctagttactttatgtctctgcagttactttccaggtttttaaggacagtgatctttgtcttctatcaccactgaagttatccccttcagaaagaagcactggcctagatatgcaacagattgttaaaaaaaaaaactgtctgataattgcaaggttgtgtatttacttatcatatcaagaagaaacgtgtggttttgactctccatttccttactaatcatcttatctgtgctacagccccaccacattatctgtgtccactccacggtggtatgttcaccacatcactggaaaataatgccactcactgacagcacacccccaccaagctccatcttctcagaggatgagggcccagactctcaacaccctcttctctctgccccctgccattgtctccagaatgggagacgacgccaacctccatgctctgactctgctgaaaccctgctcccaggccctctctggtggcctctgactccactcttctcagccacacacagaaacatactcatcttgggtttcttcatccctcaagaatcaaaccagctcccaggccaagccctctgacattgccgtcattggccacaatctgcctccccttccacctctccccaggcctggttcacctgctttttatttccataaagaacaccccattcttttatcctgcaagtccctcctgaaaccattttcagctctatcctcacacacagaccaaacccctgcagagtccccctttctatggctgccttgtcaggaaccaaccatggataaggcaccacctgccttcctctatctcctagccagtgcgacatggaggggaagctgtgcaactgtgtgccttggctccttgacaagccaggcaacctccatgagccccccaggctgatgcacagcccagctcttcatcccttgctagcatccaacagctgttcccaatctccttctttttccccagtccacaaacccacccccacgtcccaaactcgtaccagatgaattcactttataatttattgagaatttcatcctataatgacattctcaccttctctccccttctcctgagaatgtctcttatcttaccccagtgtgtctttttctgagaaatacccttcctctttttgaaacaaacatttccctctggactctaaatctctcagcttcctgattccttcctgacctccttccatttttctgtcttctaacttcttaaatttttattttttagctgtattgagatagaattgatatacagaaaattgcacacatttcatgtatacctcttcatgagtttggacatatgcacacaccatcaccacaactaaggaactaaacatattcatcacctccaaaaatttgtgtacttttttgtaagtcactttttttgtaagaacacttaacatgaactctgtcctcttaatgtattttaaaatgcacaatgctgtattgttaaccataggtactatgctgtacagcagatctccagaacttactcatcttgcataacagaaactttataccttgaaaaacaattccccatttcttccccaccgccagcccctagcagctgccattctactgtttctatgagtttgactatcttagatgccttatgtaagtgacatcatgcagtatttgtccttctgtgactggcttattttacttagtatgtcttctaggcttatcctttcttttgcaaatggcagggttttcttctttttaaaggctgaacaatattccattgtgtatatgcatggcagtttcttcatgcatccattgatggacacaggttgatttcatatcttggctattgtgaatagtgctgcaataaatgtgggagtgcagatatctctttgatataccaatttcttttcttttgggtagatacccaactgtggcatgtctgggtcatacagtactatttttagttttttgaggaactgccatgatgttttccataatgactgtagtaacttacattcccaccaacagtgtaagaatgttcccctttcttcacatctatgcaagcatgctattttttgtcttcttgataacagctattttaactgtggctagatgatattgcattattttgatttgcatttctctgatgattagtgacgtttagcatttttttcatatatctgttggccatttgtatgtcttcttttgagaaatgtctattcagatatttttctcattggattattattattattatcattattattattagccattgagtggtttgagttccttacctattctggttattaatctcttatcagatggatattttgcaaatattttctctcattctgtaggttggttgtctctttgctttgttaattgtttcctttgctgtgtataatttttttagcttgatgtgatcccatttgtccatttttgcttaggtttcctccacttttaaggtattacctaggaacaatctttgcccataccaatgtcctgaagcattttgaactgggacacttttgaaagtgaaggaggtgtcattaataattacgcaggtcaacaggcatcaagtggactgtcctgatcatcctagccccaggcttgccataaggatatttgggatttgtttgaatcgggtgtggtaagacatgcagggattaaaatgactgtcatgaaggaagaggcctccgcacaggtccctagaaacaggaggcgtggtgccccagtcagagcccaacagggaagcactgggtttagtccggggtcaaggagagtgggaatctatgggcaagagcctttattgaggtttctgtgaaaagcaacaggcaaggcaaggtaaacaggcctaagatgagctaatttgaataataggagagggtctggggcacaggggctgcccaggtgtctggcacctggccctgggtgattagggcaggtgagtagtgatcatgagtgagagccccctggagggggtcactcagggtgtaagctctggactggttggtctgtgtcagaaaagcatgcgcttgggtgacttattcactgtccttaggaattggcaacgctgggaggggcagcaaggccccaaactgtcagagcagcagaatacagaaaataaaagggatggctaatatagggactatcagagtcacccaacaggctttttcataaagtccatgctctcttcccacccccgagagttaagtccatgctcccttcccaccccctcccccaggtaagaatgactgcctgagtgagccagtgctacccatgtacacgtgcacacaccaggtgcgtgtggaaagggagagattgggagccagggctttgcctgctgcctccccctgcacccccgacttatactgacttgacacatctaatgcctcaaatctaagtttgtgtccttcgcctgctggactggatcccaccgcctgcctggtgccacagtgactcctattttctcgttcacctggaatgccttccccctccacatgtcgaagacccagctgtctcaaggccctgctacaaggctgtttcctggaaattcagcttagggctctctccctgcctgagtcccagccgcagtttacactccctcccagcgccccagcctgccttccgccatgtccacctctcctatcagtgtgcgcttcctaagcagctcctctggggcagagagaggtgtagacactcttagaatgaacaatgctgcccacctccagcgtaaggcatggtgccgatgtgccagtgccttactccctggcagcatagtaaatgggagcagaagcctctgggaaacacgctgtcttagcctagtgtttcccatagtaggttacagggcatgtgctcttcctggggtttgctgaactgcaaaacttctcacagcttagatactgaggagcctgtgatgaagagattctccttagggcattgaaaacctttttttttcttttcttttttttttttttgtaatttatgtacttgccctcttttttctgagactcatgggactggtggtcttgaaaagcataaatgtctaagaaaggtgctttcaggagactgtagggccccgcttaagcaagtggctcctcccgcagactgcaggtcatgttggctggactatcacctattttactgatgatcctaaacctctgattaaggtgacctttgcctggtgaagctaatatgtcccatctgctccttctctttggtcccccaagggacataaactaagccagcccatccccttgtccttggctccagtcaagctaatcagctttcagtcccctgaattcaccacgcttcttctcacctctgtgcctttctcacactgcctgcttcaaccgcaaatctctctctctcatatacatcacctaatatatatatgaccatatatacagacataaatataataaacacatatgtacatatgtatgaagttggacatgcatgtgtatatgctaggctagaaagatggtagatacataatagatgatatagatgatagatggtggatagatagtagatagatcaatagatagataatagagagataataggtagattatagatgatagatatagatgatagattagatagatgatagatagatagatagatagatagatagatagatagatagatagatagatgataggagagattgcttattaggctgccccttttacttaggacatatctagaaatattcactaaatgaagaaaggtaaattaaactagaaagtaagtgaatggatggatggatgggtggaaggatgcatggatggaagtagaatttgtattacacatattggagaattttaatctgataataaacagaaggtgtggcttgacaaggactccttccttgccagactttagtcagtctgctttgagccctcttcttgactaggccgtggcctgttgaactcagtttacggagacttccccaacccttgatgtctaattaagttcctcttagtgattttccacccactgacacctgactatacccctgcaccttggctataaatccttagctgtctttgctgtatgcagagttgaactcagttctatacttgtctctctcccctactgcaaaaacctttcttgccatttttaacaactgtccagtgcaatttcttcttgacaggctgtgaatgtgtacatgtatagacccattctgggtttcacttggctgctttggacaaatcttaggcattgtaggttgtcaccagcacatttgtaacatgggtgtactgcctactgggctctctgaggaaacccttccagaaagggtcagaaggcaattcttaaatgtaatgggtgctttagaagtcagcctagatttgaagtggtgtatcagcactgaagaaacactgtgttctccttcagcacgctggaagaacagcaacgtgttactcattcaagtttgtcctcttggcccttgggctcccagaataaaagatggcttctctagagtcagaagggcaagagaactgtggggaaggaagtgaacgctggctcaactgctagtgcctgcctggttcatgctaagcactctgtccgtgtggcctcacgcaatcttgccagcaacctgcttgggcagatatcatcactgtttcacacctgggtgctcatccatgtggcttctcttcacctggcctcttggcattagtctagccctagcttctttatagcatgatggtggcttccccagggtagcagaagctgctggtcttcttaagggccagaatcaggactggcttaaaaatcatcactttgtctacattttattggtcagggagtgtcaaagctttgcccccaattcaaggggcaggaaaagactccacttcttgaaagtagagcagtgttcctgaatagggaggggaggaattgatggagaccatctactgcctgccctgacccgggacggggacctggtagggattctgctcactgaggccaggaagcaggtattggacacctgtggcatcatggaccggaagtgcattatacctacctgggccaggtacaggtgctgacggactcagaaacagatgtagggattagtggaatccaggactaacctacactcgcttacagtaagcctgcatgtcacaaatccgaggtggccctgtagagggagccacggcctttttctgctagtttgggctagccctgggccacagcagccagcccatcggtccagggggagtctagaatgtgcagcgaggccctccgggtgcttgctggccaagctgcctgggctgtgtggctgtatcacagtcctgaccgcaccctcccagccttcccagaacagagcttccaaggcgaaaacacctcctggctgttctccttccccaaatggctatgttttatgatgtgctaagtttgggggggaaaaaagaaaattcctccagctgtggtgtaatcccatctgaaggcattccagggatttgatttataatctctgggcatgagccgcatgctgggctctgtgagaggggcgcctgtccggggcgctgcagggccagggccgttgaggccctccgggtggagctgcctcctttgtgggttcccagtttccagcatgctggagctgtctccaagcccaagttgtgcatggaacaggcatgcagctaatattcagaatcaggatgagctcactctgctaccaacttgcataatatttatttattcactcatttaacaaagtttctggggactagaaaataccttaggtactgataatacaaaatgaatatggcaaagattgaaatacgtttgaaccaaggttaatatcagaggtaggtattgaaagtttcaacccaacaatcagcttgtaaaacagcggtctgttttctttccctttttttttttttttttcaagaggggttgaattatttttgtgagggtgctggtaagaggaagctctacatgaattattggagaataacagttctgaaaggagatgtggctgttctaagcccagcctggtgctggtctccccagtgtctttctctcgagaaagaaacaaatgaaagttgatctcagcaaccaggacccatctgggtacccacacctttccttcccagcagccctgcagggttgaggcttgttctcacagcctggaacacaagaatagcatgtgttccagatggagcagaatgattctggcctaggaaagacattataccgaatgggtttcagattcttattggtatctgggaaaggacggacagccacttctacttaaagaaatgcccacaatcccacttcccatcatgggcagaacatgcacatgaactgcaccccacagaggaccctgtgtacagggtggtgcaaggccaacataaaatcaagtcaggccaaagaggaaaagtgtctttgcccaaccgcggtattgtgaagggagccttgcacagctgagtcactattttgattcaaagactgtctatttctttttgtcctccctttgtccctttgtttccttggttgaaattgtgctcggtgagtgaactgtccctggcctgctactagggtcagcagggcctgagtctcatgtcacctttgatcatcattggcagcttctccagctccctgagacagtcagggcagggggctttaaaatctttgagcaactgtatacatagagggctgaatcctagacacagctgacatatactatgacttatttcatttttaaccagtaagtcttgggtctatctgttattagcagaagcttctaagcaaaacaagaattccaaaattcaggaggattagcttgacagatttcccaaacaccttggacagcaacatgagttaaaatgtgacccccatcatcactatgcattcatcatgactagcttgcctctctcaaaaaatggcctgggagagaatgggccagaggtgctgttctatctgtcaaatgtgatctatgtaatcatcctagttggcactgcagaatgaaaactcaaatgtgtctcttctcattccatgaaaaaggaaagctcctgagggttctctgtgacaatacttatgctacttattcttggtcctgtggtggcactcagtttctctaaaagcgaaaggacattatggtggcctacttcacccaaatgctaggagatcacacagtgaaagtcaggtatttgcattcattcactccttagaaactatgtactgctggaaactgaggagcagagacatcccctgcccctacaggacagtgttggtgaggatggatttaaagacaacagagcagaatccgagttgccccctgccctgattcaacaccagctgtcaacatcagctggcagagaggaggaaaagtggcttccaaagacgaaaagaacaatcaaggaagccattcgaagatagtagaaaagaaagcaacagtcagctcaagaatacgcagtagatgaaaactacagcttccacacaggaagagctaaaggagagaggccctcaaaaaaaggttacaagaagagtttaaaagtgagttgaccattttaatgatattgattcttccaatcatgagcatggaatgttcttccatttgtttgcatcatctgtgatttctttcagcgtgtaattaattctccatgtagagatctttcacctccttggttagatgtattgctagatatttttgtggctgttgtcaataggattgtattcttgatttgactctcagattgaacattattggtgtatagaaatgctactgatttttgtaccttgattttgtctgttgaaactttacagaagttgtttaccatttctagaagccttctagtggggtctttaggggttttttggtttagaattatattatctcttatttctttttcttgcatgattgctctggctaggacttccaggactatgttgaagagaagttaatgggtatgggcatgaacagacacttcccaaaacaagacatacatgcaaccaaaaaacatatgagaaaatgctccacatcactaatcactagagaaatgcagccacaatgagataccatctcacaccaatcagaatggctattattaaaaagtcaaaaaataacatgctgatgaggctgtggagaaaagggcatgctcatacattattggcgggagtgtaattagttcagccactgtggaaagcagtttggatatttctcaaagaacttaatacagagctaccatttaacccagcaatcccattactgggtatatatccaaagaaaaataaattattctaccaaaaagacacatgcacttgtatgtgcatctcagcacaatttacaatagtgaagacatggaatcaacctgggttcccatcagtggtggactggataaagaaaatgtggtacatatacaccagggaatactacacagccatataaagagaacgaaatcatgtcctttgcagcaacatggatgcagctggatgccattatcttaaatgaattaatgcaggaacaaaataaaacaaatactgtatgctctcacttacaagtgggagctaaatattgggtactcatggacataaagatggaaacaataaacactgggaactcctacagtggggagagagggagggaggcaagagttcaaaaattacctattgagtactatgctgattacctgggtggtgggatcagtcatatgccaaacctcagcatcacgtaatatacccatgtaacaaacctgcacatgtatcccctgaatctaaaataaaagttgaaattttttaaaaaagagagaaatgacttagcatgtcaatgaaagactttatattaatgacaaactctagtggaatatatgtccattttcttcacttttacgtaataaaatttaaaactttcaaaaataaaagataaatgagtcgacaacggtgcttggggaaaacaattcttgtttgttaatactctccaacccagctcttttgccttccagctggctagtcattaaacagttaaatgaaacaataaagtgtgctcactccctctgtgtatgagaattatgtttccaacacaatagattcctccataacaacactgaatgttaagagaaagtaagtgaaacaatgtctacaagccctccaagtgagaaaaaaatgacacatgaattttatacagagccaaaatgtcacatacatataaagaacttcaattaattgaaagaatgccagaaatcaaggacagtagaacttgtgagcccatcttggaaaaccttttggaggatgaactgtcatcagccaagttatgcataatgaaatttctatatactagctaaagagacaaaacaaatttgtcattacattatgctctttggatatttaattcactcctccttatcctaatattcctaatttcataaccagaagctgaagtgatgtcactttatccatgtaagttcttctccaggctcttcaggtgctaatatgcttaaatctcttcaaatattttatagtgtttgtttttgtcgacaattggaatatgaccatgttcctgcctgtcctacttattatacgggtgtgtcaaaagggcaagtgtgtcacagggcaagtggcatagcaccaggagatacacacctgcacgaatgtccatgtatctgggtgtgggcaaccagagtgcacatgagaatgagaagggctacttctgtgactttcctgaaccaatagtcccaatagagccaggctagagcaaaaccacagcctccaaacccagaggtgcctcccccagcactgatttaggagcccccagcccatctccaagtgttgtgcggcactctgaagttcctcctcacccccttgaggcagctgctccgtgggtctctggactcctcaaactctgattcccctggcagaacaccctcctggctgcaggtgtggctcctgtcccagcctcaaagcaacaggttcctgtgctcccatcattacagcgaagagctgagggctcttttcttttaattgaatcccctgaggaacgccccccaacaacaggatatccccaggctatctgttcttatcatactcataatgtttggctttgtcatgccattcacccagcctcaacttaacacactttccctgaaggtctaaatccagacaaaaatatgagcaacccttctcaacacttggcctccctaacataattacaaaccccttattcatagtctttggctctgtccagagcttaggcagtctcttcatgcctggatgattctcccacacagtatgtgacctgagaagtcaggaatgatcattgtgctctaatgtcatagcaagtggcatgccacctagctctgggggtggcagtcggtgccagaggccctgtcattgtcttccctagaggccataagaactctcatggaaataagttgaccccacaggtatgccagcccagacatcctggtgaggccccagcatgccccagttctcaacggcaagcagctcgggaagtaccgaaaggacccaggcaccatttagttttgtaaggccattcagtaaagctcaggctcttggaaagccagcctctttgattcagtcctttgttgctactcgctttaatgtttacctcattttctgcttcatgcagccagaattactggtaaataagcccttcagcaaccgtagagtcttgtgctctgctggagatgtatatgcttggagaatgaaatactgtgaacatacatatttcagtttggactgtgaaatgccttctatacatctgatttgtaagagagatggttctgatcgctaacatctcagtggtgatcctgaggagaaaggcttgacagaattttaaaggtgctctatggagtataattaaccaaatccaccccccctccgtatctgaaaaagaattctggcagtgttaccagtgaggaagataggttcttttgcataaagggacgtttagttgtttccctggggttattatttccaagcctggctgtgtgatggactcagtttccccagttgcattccaatccattcttcagaccagtccaaaacagtacttaacttataggagagaaacagtgttttaccataaaatgtgcttctgttgtaagtttgctgtagctatgccctagcagattaaggtaattcccttctattccaagtttactaaaattttttatttttaaaatatagaatggatatcaaatttgattcgaattttttttctgcatctattgaggaatggctcttgggaacaatattttctgagctcttgcatgttgatttcaattttcaccctgtgcatcaaggtcagtttttctagacataacatattggctcataaaaatctttccttggacatcttattattccatcttcttttgtattaaagcattactcttaaaaatctgataatcatctaattttcttttcctcatattcttttgcgtaaatcctcccccctccccattttctttcttcaaactgcagcaattttacttaaaatttattaaaccttggtattggtcatactcatttgatggtttcaggtatgtactatgatacttcaacatataattttaaaaacaattatttcaggaaaattttctttaattattactctaaatatttcttgaattagtgaatttgttctgaacccttgctttggtttttcttctttaaactttctgttatctatctactagtcttctttacctatcattgatccttcttatgctcttaaatcctgttttctttctccattttgttttgaaattattcctcttaagctttctatttattgtaaagcatcagttatcaatttttttgtgttccttctagtttatagattttatttctaatttttgtttctaactctttcttgattttcatactgctttaaatttttctagttctgatttttgttattccatcctgttttatgcaattctcctattgtctttaagctcattttgaaatagtaggatatcgttttctgtgacttcccgagctgcttgccattgagaactgtgttttgagtgtatctttctggtgtaccttcattgtttgtaagggatgctattcagctcctcagtcttttttttttcttatggtaacttgtacgggatttgatcataatattttctagtgcttgtttccatgtgaatttggatttcctgaactaaacttgacttggacagacagctcttataagttcactgagcttgctttctgaggttttctggctctattctcctcaatcacttttataggatcttctcttttctttatcccattctctccattctctcctcaactttgattctaaggtttctcctcagtgtgactctgttctggaaaggagccctggctggtcaccttttagagcagataagagctacactgctctaaccccttcaggccctaccatgtactcctcgcacttttccactttgaaggtgaaattaaagggatacaaagaaatggaagaacattccatgctcatgggtaggaagaatcaatatcgtgaaaatggccatactgcccaaggtaatttatagattcaatgccatccccatcaagctaccaatgactttcttcacagaattggaaaaaactactttaaagttcatatggaaccaaaaaagagcccgcatcgccaagtcaatcctaagccaaaagaacaaagctggaggcatcacgctacctgacttcaaactatgctacaaggctacagtaaccaaaacagcatggtactggtaccaaaacagagatatagatcaatggaacagaacagagccctcagaaataacgccacatatctacaactatctgatctttgacaaacctgagaaaaacaagcaatggggaaaggattccctatttaataaatggtgttgggaaaactggctagccatatgtggaaagctgaaactggatcccttccttacaccttatacaaaaattaattcaagatggattaaagacttaaacattagacctaaaaccataaaaaccctagaagaaaacctaggcattaccattcaggacataggcatgggcaaggacttcatgtctaaaacaccaaaagcaatggcaacaaaagacaaaattgacaaataggatctaattaaactaaagagcttctgcagagcaaaagaaactaccatcagagtgaacaggcaacctacaaaatgggagaaaatttttgcaacctactcatctgacaaagggctaatatccagaatctacaatgaactcaaacaaatttacaagaaaaaaacaaccccatcaaaaagtgggcaaaggacatgaacagacacttctcaaaagaagacatttatgcagccaaaaaacacatgaaaaaatgctcaccatcactggccatcagagaaatgcaaatcaaaaccacaatgagataccatctcacaccagttagaatggcaatcattaaaaagtcaggaaacaacaggtgctggagaggatgtggagaaataggaacacttttacactattggtgggactgtaaactagttcaaccattgtggaagtcagtgtggcgattcctcagggatctagaactagaaataccatttgactcagccatcccattactgggtatatacccaaagtactataaatcatgctgctataaagacacatgcacatgtatgtttattgcagcactattcacaatagcaaagacttggaaccaacccaaatgtccaacaatgatagactggattaagaaaatgtggcacatatacaccatgggatagtatgcggccataaaaaatgatgagttcatgtcctttgtagggacatggatgaaattggaaatcatcattctcagtaaactatcgcaaggacaaaaaaccaaacaccgcatgttctcactcataggtgggaattgaacaatgagaacacatggacacaggaaggggaacatcacactctggggactgttgtggggtggggggaggggggagggatagcattaggagatatacctaatgctaaatgacgagttaatgggtgcagcacaccagcatggcacatgtatacatatgtaactaacctgcacattgtgcacatgtaccctaaaacataaagtataataataatgaaattaaaaaaaaaaaaaaagaaagtgagcaatgcccatccagtttcagacgccatcctcagcttagccccaccacacctcctagtaaatatctgttggatctttaggctgtgttcaggtctatcagttggtaaataaaacgggtccttcaccagagtttgagaagcattgctgaaggaatcagcagagggagagatgagtgttagaaggcttcatagaagagatagttcttaggccaggccctggagggcaatcagggttgaagtgaatgttgaagttcctcagtgctctgcccttggcctccatctcactttgtttgtggagcttatccattcccatgccctcaaacatcactttcaaggcaagcattcctccagacctgagttttcagctcaggaatcttttttaacatgaaacttgtagagacacttgcataggtataatgaattcagcatgaaccaaacaagtgcatgactttctccccaagttttgtcaatgaatctcaaaagttttgttgcgtttttattttcgttcagttccaaatattttgtaacttctaattttttctctgactcataagttatttagaagtatgctgtttaatttccaaatattttggaattttaaaaatatcttcacattattgatttctagttaattccataatcatactttatatagttacattcttctgaaatatagtgagactaatgacccaaaatacagtctcttttggtgaatgttctatgtccgcttgaaaagaatgtgtattctgctgtagtttagtgttctgtaagtatcagttaggtcaagcaggttggtagggttattcaaatcttttacgtcttattttctgtttacttgttctatcaattacttagagacaaatgctgaaacctcaaactctaattatggatttgcatatttttccagtttgatcttatatatccatttttgtttcatgtatttgaagctctgtatttgaaatgctatccttagcatacagtaaattcacaaatataaatgagtctgtaatgctcaactctattttgttccatttatctatctatatatccatgtgccagaatcagattgttttaattactgtgactttagataatactttgactatcgttaaggcaaaccttttccctttcctccagttaatttttctttctcaaaaatatcttagctcttttcatacatttactgttcatttagaatgtaagcatcatctgggcacgttcttgttaagtttaatcttaagtatttcacatattttataaaatatacattttatatatgcctgttgctcaaagatatttttcctgttgaagatacagaacaggggttggcaaaaattttctttaaagggccaggtggtaaaaattgtaggctttataagacatatgatctctgctgatactattcactcagtcatcgccataatacaaaagcagccacagacaatatgtaaacaaatgggcataaaactttatttacaaaaaaaggcaagaagtcagatatggcctgtgggccatagtttgctggttgtagataaagagacagactaatagatatagagaaagattaatttttacatagttatcttgtatcttaacttcataataagtttgctaatactatttttgagttgagtctattatttctatgtgaacaacgtatgaacaaaagatcattttcttctagctttccaatatttacagcaattattccacttttgtaatcttactgcattggctagataactctggagcaatactcagctactgtgctaacaggaggtattgttttgttaataggggggctctgtttttcacctacaaatttgatgttgctgttggtttctaaaaaatgttatcacgttcaagtttcagatacaatgcttgtattcaatcttttaagatcccttctaattcaaattgtttaattatgaagtaattaccagtttttgattgaggctatagacaaatgagtgttccagtgagcaatccatcacccccattgaataccaatgacttgtttttacttaatagagaccttctgaatcttcttgttcaattacatgaacctcaagacaacatagaagaaaacgaattcttccgaggaattagaaaaaaattaagtaggaaataaaagtattttgctttagactttttaaaggtgttttcctttgaggtttttcaataaaaataaatcactaaaataacttttgagtgctaaaggtaaatttagctgaaaattcaataatgttctaaggagattgggggtaaaaggtccaaaggaagataaattactaactctaatatggaagaaaaaaatctaagatgtttatttctgaaaagctttggtctaacatgtaagcctcaagaacatacaactttaaaaatatgtatttaaaattgaaagttaataaatatatatatgcttatatttaaatattttaaaacttcctttaaattagcattcatatactcacaaaggtgtcaatgaaaatttcatgttcacattgcaggcagaaattgattcattattgatataaaattatttcaatcagtcaaaagttttcactttggcattcaccttccaagaatgaagtgaaaacaaatgcaattagtatttccatattcactcctttaatttccctggaaaactaaaaattagtccagctgtaaaaatatgaggcacacattaaagaagagacatgtttaacatcaagcattgtggaatttttctttacaagacgatttcaaggcccagataaataaaaatacttcaggcaatacacagtaaatattttattttaataatagcatagaattcttctgaagaaaattgttatacattatagctattattttacagtaacagagagaaaataaaattagagatacaaatattaaaggccaattatcaaaatgaaattaacacagattattattcatatgaacaatgtaaacagaatcatctatttgatttaacatcaaatatatttttggcatataattatttttacaatgagaattattaattattcaaccaattcaaatatactcattcagccaaaagaacaaaataagcctcttagaaattcaagatttatagattgatattaaacattttctcaatacatagaatattctgatctccattgagttaaactgtacaaacactcatatctattgttttatagcttataattaggtatagcttgtcaccagaactccttgtccaaaatatcactattaattgtacgaggcaaagtcctataataaaattactgtaataatggccacatcttttcaaaaacagaatatggaagtttccattttcatgactatgaatctggttttccaaaattgggttcccaaatccagtttctaaatgtttcaacagaggtgagaaagtaaaggaaataaatgatttaatggaactctggaaaaaaaactatcatagatcttagtttgaaaaatacatcaaacatgagatataccatgaatgactcagaattatataataatgcctatatcaaactttattagttagctaaagggcaaagagtaagaggcaagttaaaggtaatacttgcttttaacaaagcagactaagtaatatgttaagtgttagggtgggataggaaagaactcaggcatggcaaaaatctcctcttgggctttctatataaacatctattttagttttggactgttcaccgagaggagctctccctatccatgaaatgcttcccagaccaacaggtcttggtctagcagctgtaggaaggcagcagtatgaaaatgtaggaaatggaagccaatttgtgtccaaagttagtccaccctaactggactctttttaaactgggttattcaaatgccagcaaaaagtacaggctctagctaaagaacatgaatagacatctgtcttaaaaatgcctggaagaggtcatgattattggccttatgttctcccagaataagaacttacaaagtcctggaaatcctcagctctctccagccacctttccaaataaaatcttaatgaatatattttaaatcctttattgggctctgtaatcccttcaaccaaatagccaagctgcaatcgttttatgtaacatctgtttcactggaaaatgtgggaagttattttgatattgtctagcaagatcaataagtaaacactgatcaccccaagccaaatgatattgcccttcagggagcttttagaaagaaaataaactgataaaccaagaaagcagattgtatgcatagcaaagcccttcagcacagtgcaaacatgttctttatgaggaggtgcaaacccacttggtaatttcaagtgagaggcaacagaagtctttcttaatccaaagtcagaagtttccgaagaacttcaagcacaatatcgtaacaaaagtgatactgctcctatatacatatatataaaaaacaacagaatgttaagtaattgaataacagaatccactttcagaaaacacatttgtaattttcagccacactggaaagttcctaaaaagagcaaacatttaactataaacacttaagaactttacgtgaatacatttttaaaactatgaggaagataaatgatcaaaatatagctcttggcctagaactagttaccttaaggcttaacataactgttttttttatcattatccatattctattaatctaccctcccaatgactactaacaaatctgtgacataaatgatgtctttttatgacgtcctgataaccttgacagtttagtggcaagtaaatatctcaaactgctatccagaaatgttttaaaaataactttagatgttacttaaatagcacggcattatggacaaggcatgtgtttggacacgaggagacctcaacttcaggcttggctcctccccttctatctgagtgaccccatggagcaggctttattgctctgaatttgaagtacttggtcaggaataccagagaatcagagcaaaactaatgtctacctcaaacagtaggaattcaatgagattatgtcaataaaagagcttttaagtggtaaaatgttatgcaatgttaatctttatattcattattcttattattatgtatgtggtgaaagcttaccttcgtttgaaccatgccagaacgttgttctctcatttgggccactatatccatgatgttgaactgtaataagatgacagtaattttgtatgatccacatgggggaaaaacacaaattcacagattgccaaaaagggtgaaagagatgtcaagatttaatcagaaagatctcattttcactcacaagaaaatgtgctatttttaacttagcccaatggataaggaagactattttaataggttttcaggagaaagcaggaagcaatcattcataataagaaatgctctccaaaataagtaataaatttgcccttgtgtgtccctgtttgttatccaaaggcagaacttaaagcagcactgtaattctggaaaggcacagaagactttctctggccccaacaatagcatatctgtttcttatatgaagatccctgtcaactcacacggaaactgggagcaacagtcgacccaacactagattccagactgtgtgtggacaccagtacagctgggtgtggtcattgagttggtgcaggcctacaaaggtctgttgctggtccacaatgagtcaagaaactgggagtaagtgctcagaaactcttatggcaatttgacactggcacagcactgagaagtgtgctcaactgaacaggatatagaccagctcaggtgttgctgaacttgcctggagagtcacatgtgggacaagctgagaatgagtcgtttcagcaagacattgtggacacatgtaaatgttgtcaactgtaaccccaaagcatataaaaatagaaaacaataagcattcctttattttcatagcttatcatttttataattaaaatttttaattaaccctttgaaaaaactttttgttttttagagacagggtcttgctctgttgtctcagctgctggagtacagcggtgtcatcatatttcactgcaatctcaaactacaatcctccctcctcaacctcctgagtagcaagaactataggtgcgttccaccatgcccagctaacttttttatttttatttttgtagagatggggtctccctatgttacccaggctggtttcaaactcctggcctaaagtgatcctcagccttggcctcctaaggtctgggattataggcgtcagccaccatatctgccataaaaaacattttattttataatacagatatacaggaagttgtacagggtggccctgtgtatctttcacccagtttcccagatggtgtcatcttgtttaacaagatataatatcaaaaccaggaaactgacattgggacaatccacaaagcttaattcagatttcaccagttttacatgcaactgttagtgagtgtgtgagagtgtgtatgtgtgcatgtgtgcatgcacagagctccatgcaattatatcatatgtgaagattcatgtaactataaccacagtccagatacagagctgttccaccacaagacttcctcctgctatccctatagagtcacactcatccaccccaatctctaacccttggaaaatagtaatctgttctccttctctatgcttttgctatttcaagaagaaatagcaaaattcactatatgaataaaattgcacaatagctaaccttttgtgattgacttttttcccacccagaataacttggagatccatccaagttgttggtgtaacaatagtttgcttccttttattgctaaataatattccatgatgtggatatgtgccactttatttaaccatcaatttgttgaaggacatctgggttgttctggtttttggctactgtgaatataatctgctatgaacatttacatacaggtttctgtatgaacataaattttgattaatctgggataaatgccccaagagtgctattgctgggttatatgtcaactttagttagttttgtttttgttttctttccaagaaactgctcaattgttttccgcagtggctggtaccagtctacattcccaatgtctcatacatatgggtaatgtatgagcaatacagtttctccaaatcttcacataattctccaaatcctcaccagcatttccaaatcttcatcagcatggggtgctgtcactatttttacataagcctttctgataggtgtgtaatgctactccatcctggttttaattagcatttccccaagggctaatgaagctgagcatcttttcacgtgcttgtcatctgtatgttctctttggtgaactgtctgttcatgtcttttacccatttctgtttttcttttttttttaactattgatttttgagggttccttataaattctagatccaaggcctttgttggatatgtgccctgcatatagttactctctagcttgtttttttttttttatcctcttcattgggtctttcacaaaacataaaattttagtttgctttccctctgagatcagtgatggcaacaacgcctgctctcaccactcttattcaatatagcacttgacattttagtacagcaataagaccagaaaataagtaggatgtatacagattgtatacagatcaaaaaggaagagacaaatctatatgcacatggcatgactgtctatgtagaacacactaaagaatctaaaaaaaaaaaaacctacaaaacctctaagagctaataagtaatttcaacaagatcacagggtacaagatcaacaaatgaaaatcaattaaatttctacgtactagcaatgaatatgtggaaactgaaagtacaaacacaataccatttacaattgctccaaagaaaatgaatagggtaaatttaacaaaacatatacaagatctatacactgaaaatgacaaaatgctgatgcaagaattcaaagaagacctaaataaatacacttaccatgttcatggattggaagattcaatacagtaaagatatcagctctctccaattaaactacagatttaaagtaatttccatccaaatcccagcaagttttgtgtagatgtagccaaactaattctaaaatttattagagaaagcacagaccctaggatagctcaaacaattttgaaaaaggagaataacgtgggaggaatcattctatctgatgttaaagcttactatatcactacaataatccaaagggtggtaccggcagaaggatagacacactaatcaatagaacagaatacggaaccagaaataggcccatacaaatatgcccaataatttttgacaaaggtacaacaataattcaatagaggaataacagaattttcaataaatgatattgaaacaactagccatcaataggccaaaaaatgaatcttcacctaaatttaataatttattaactcaaaatggactatggacttaaatgtcaaatatgaacttacagaattttcataaaagaacacaaaaaaattattcaggccctcagctaagtgatgagctgttagacttgatatcaaaacatgatccataaaaggaaaaactaataaaatacaatctcatcagaattaaaaactgtaacttctttaaaagcatttttttaattataatttaagattaggcaaattatggaaatacatttgaattactaatttttaatcagtttactgactataaaacaagcatgactggactgttcagttaagaaaagacacagctttccaaatgtggctgtagtggttaaccaaataatgaagatggaagtgactgcaatgaaatgaagacaaagagttatataattttcacttggagttatgattcctcatatattgagttttatagtcattattgattgtgaagctctaaaactacacttgtgttatttccaaagatgtactggttaacaaagcaaaggaaccattaagacttatttgtaatttacataaaaaataattaattcaaagataaaataattatcttaaagagaattagattaaaaagacaagagaggacttctggttccaaaataacagtgtagaagcaagctggcttcacttctttacaaagaaaaccaaaaccaaatatacagcactgaaattatcaccaacaatatcccagaaatcaaatacgaggagaagacagttcctggatccacagagatgggaaaaaaactctaagtaggcagtaagagaattgggtttccacatctgcaatgcccattcctccaatttgcccagcaccaagagtgcaaaaaatctccacctgattcatgatttctataccagaaaaggtgacatccaggtttcccaccatctgggttacctggcaggaaacctgtccctacctcaacccacaggaagcactacatgtgcctgaagaaagaaatatcctgagaacagtcagaaacaaacaggtgaggtgggactaccatccccagccctggaaactctggtctgtaactcagctaaaggagatgccaaaccagagtggttgtttagtagcaccacattgcagaagatacattgcacaggacccctgggcatgaatctctagccacctttcccacactgccatgatatctcctttgagactttccctaattggaatgagcagctctcttattgtttactggagccaaggcaaacttggtcgtaaggtgacatctagtgccaaaaagaaggcagcaacttagcccctcaccaaaaaaaaaaaaaaaaaaaaagaaaaaaaaaattcgacaggtaaattacatagaatctataaccaaatacattcaataaaaaacaaaaataagccagacagagaacactggaataaataactaatccttcattcaaagacatcaatacaagatatatatttcttgcacatccagaagaaactgcagtcaacacaaaaccatgacctccccaaatggataaagcaaggaaccagtgactgaccctcatgagatagccatataagagctccctgatcaaaaattcaaactagtattaatagctttgaggaaactcagagatctccaaggtaacagaacaccaattcaaaaatttattagacaaacttaacaaagagattgaaataatttaaaaatcaaatagaaatcttggagctgagaaatatattagctgaactgaaaaattcattacagcctcacaatagcagaatgaatcaagcagaggaaagaatcagtgagcttgaaaaccggctacttgaaaatgcagtcataggtggaaaaagaataaaaaagaatgaagatcatcaccaaatatagacaattacctcaaaagaccaaatccaaaaattactggtgttcaagagggagttgaacaagagcaaggggtaggaagcttattcaaagaaataataacaaaactttccaaaatgcaacagatataaatattcaggtataagagcatcagggccgggcgcggtggctcacgcttgtaatcccagcactttgggaggccgaggcgggcggatcacgaggtcaggagatcgagaccatcctggctaacacggtgaaaccccgtctctactaaaaaaatacaaaaaaattagccgggcgtgatggcgggcgcctgtagtcccagctacttgggaggctgaggcaggagaatggcgtgaacctgggaggcggcggagcttgcagtgagccgagattgcgccactgcactcccgcctgggccacagagcgagactccgtctcaaaaaaaaaaaaaaaaaaaaaaaaaagagcatcagagaacaccaaacatattcaacccaaataaggctacaccaaagcataaaataataaaactctcaaagctcaaggatagaggatcctaaaaagtagcaggagaaaagaagtaattaacatataaaagagctccaattcatctgacaattgactctcaacagaaatcatataggccaggaggaagtgggataaattttcaaagtgttgaaagaaaaaaaaaacctgttatccaagaacactatattcagcaaaggtacttttaaatatgaaggagtgataaagtatttttcagataaacaaaatctgaggattcaacagcagcagacctgacttacaagaaatgctaaagcgagttcttcagaaggaaaataaaaaaatacaaaaaaccacatacacattcaaaaagaaaacttttcaaggcataaaatccactggtaacattaacaacatggacaaaaccagaatactctattattgtaatgatggtgtgcaatccatgcctaactctggtatgaagctgaaagataaactcataaaaagccgtaatagctacagcaacctattaagagaaaggtaatataaaaatacacaaatttagataataagcagttgaaatgtggtggggatggagttaaagcatagagtatttttttaaaattttttctttgtttctattctttactttgtgatctaagataagttgtcacttctttaaaatagcttattgagatccactcaaggcaaaaagaactgggaagtccccacagctgtctgctgggcagaaaaccctaggctatgggtgccacatcagccatacacccacggcaacaccgccctgcctggagatctcacacccttgacctactgcatcaacaaaccatctgtaggtctactgcacaattagctctgactcccaagcacagaggatcagcaggcctccagtgtgctgtggatctcctggtgacctaatctttggctcgagctgccccaagggaggagagagcacaggctgccagggttccccttggggttaaagagatgtgggcatggtgccagtgactggagggggctcccctaaggcctggaaatggacctggcaggggatcatcgctaccccttcccaccacccccactgctgcaaatgtgctggaatacaaaagagccatgtgactgagagtctatttgccggccattattctcaagcaccatctactggattgaagcctaaattacaacaccccaaactcttccagtatacactgcctgtgaaatccagtgccagaatctagccacaagtattaataaatatcccatacagagtgttggccctctgaaagcacccagaaataaagccaactgactatactcagcttatgctacagtcaaacccacaagggatacaaagaatataaaaacaaaaagcctcatcgaaatgatagcaaattcaacaagataaaagaacacgtgccctctcagaagagaaagatttaatgcaagaactttggcaattcaaaaagtcagtgcctccttatctccaaacaattgtactagctcgccagaaattgttcttaactaaattgagatggctgaaatgacaaacatagaactcagaatctgggtggtaaggaagcttaatgagattcaggagacagctgaaacctaatccaaggaatttggtaaaatgatccaagagttaaaaagttgacaaagccattttaagaaacaaacaaactgaccttctggaattgaaaaattcactacagaaaatttcataatacagttggaagcattaacaacggaatagaccaagatgaggaaagaatctcagagctcaaagattggtccttcaaatcaattcagtcagacaaaaataaagaaaaaagaatttcgggccaggggtggtggctcatgcctatgatcccagcactttgggaggctgaggtgggaggatctcttggggccaggagtttgagacctgcctggccaacatggtgaaaccccatctctactaaaaatacaaaaactagtgaggcttggtggcacgcgcttgtagtcccagttactcaggaggctgaggcatgaaaattgcttgaacctgagaggtggaggatgtagtgagctgagatcacgccactgcactccagcctgggcgacagaccaagactctgtctcaaaaaaaaaaaaaaaaaaattgaaaatgaacaaaacctccaagaaataagagattatgtaaagagaccaaacctatgactcactggcatttctgaaagagaagaagagtaaacaacttggaaaacatatttgaaaatatagtgcgcaaaacttttcccaatctcactagagaagtcaataggcaaatttaagaaattcagcaaagtcctgtgagataccatacaagatgaccatcctcaagacatatagttaacagattcaccaaggtcaatgcaaaagaaaaaatcttaaaggcagctagagagaaaggtcagcttacttacaaaggaaatcccatcaggctaggagtagacctctcagcagaaacttgaaacttacaagtgagaagaaactgtggacctattttcagcattattaaataaaataaactccaaacaataatttgatattcttccaaagaaagcttcataagcaaaggagaaataaaatccttttcagacaatcaaagctaaggaaattcatgagcactagaccagtcttacaagaagtccttaaggaagtgctaaatgtggaaatgaaagaacagtacctggcaccacaaaaacacaagtacatggcccacagacaccataaaggagatacacaatcaaatctacaaagcaaccagccaacaatgtgatgacagcatcaaaatctcacatattgatataaaccttgaaggcaaatggtctaaatacccaacttaaaaggcttaggatggcaaaatggattaaaaaaataaggcccaaccatattctgtcttcaagagacccatctcacatgtaagaacacccacaggctcaaagtaaagggatggagaaagatctatcatgcaaatggaaaacaaaacgaaagcaggggtcactattcttatatcagataaaacagactttaaaccaacaatgatctaaaaggacaaagtagggcattacacagtgacaaagggaaaaattcaaaaagaagagttaactatcttaaatatacacacagctaacattggagcacccggattcataaaacaagttcttctggacctatgaaaagacttagtcacacaataatattgggagccttcaacacccaactggcaggattagagagatcatcaaagcgaaaaattaattaataaagaaattctggtcttaaattcaacacttgaccaattggactcaataaatatctacagactagtccactccaaaaccataggatatacagtcttcttatctgcacatggaatatactctaagatcgactatatgctcagccataaagcaaatctgaaaaagattaaaaacactgaaatcatctcaagcatactctcagaccacagtacaataaaaacagaaattactaccaagaagatctcccaaaactacacaattacttggaaattaaacaacttgctcctaaatgacttttgggtaaacaaatgaattcagaaatcaaaaaaattctttgaaattaatgaaaacagagacaaaacaaatcaaaatctttgggatgcagctaaagcagtgctaagagtatagtttatagtgctaaatgcctacatcaaagaagttaggaagatcttaaatgaacaacctgatgtctcacctagagaaactagaaaaaaagaacgaatcaatcccaaactagcagaagaaaacaaataaccaaaatcagagcagaactgaatgaaattaagatggaaaaatgcatacgaaagatcaacaaacaattttttttttttgagatggagtctcgctctgtctcccaggctggagtgcagtgacacaatctcagctcactgcaacctctgcctcttgggttcaagcaattctcctgtctcagcttcccaagtagctgggactgcaggtgcatgccatcacacctggctaatttttgtatttttagtagagacggggtttcgccatattgatcaggctggtctcgaactcctgacctcaggtgatccacccgcctcggcttcccaaagtgctgggatcacaggcatgagccaccgcgcctggtctgttttttgaaagaataaacaaaattgatagactgctagctaaacaacaaaaaaaggaaaatctaagcccaatcagaaatgacaaagatgacattacaactaatcccacagaaatataaaagatcttcagagattattataaatatctatgcacacgaaaaatagaaaatctagaggaaatgagtaaattcctgaaaactcccaagattcaaccaggaagaaattcctgttcaagaaaacctgaacagaccaataatgaattccaaaagtgaatcagtaataaaaatcctaccaaccaaaaaaagccctggaccagacggattcacagctaaagtctaccacatgtacaaagaagaactgctaccaatcctactgaaaccattccaaaaaattcaaggaggagggactcctctctaactcattctatgaagccattatcaacttgataccaaaatctgacagagacacaatgaaaaaaaagttcaagccaatatccccgatgaacatagaggcaaaaaaaaaaaaaatcctcaacaaaatactagcaaaacaaatgtaacaacacatcaaaaagataatgcactatgaccaagtgggatttatccccagaatgcaagtataatttgacatatgcaaatcaataaatgtgatatatcaacagaatgaatgacaaaaaccatatgagaatcttaatagatgtggaagaagcatttgataaaattcaacatgctttcatgataaaaaaaaaaactctaaacaaatgaggcatagaaggaacatatctaaacacaataaagacgatatatgacaaacacacagctaagatcatactgaatggggaaaagctcaaagcctttcttctaagaactggaaaacaggtcaagaatgcccacttttaccactcttattcagtataatgttggatgtcctagccattgcaattagtcaagagaaagaaataaggggcatccaaattggaaaaaaaggaaattaaattgtccttctttgcatgtaacatgactatatattcatatattcatatatatatgtatatatatatatatcccccaaaactaatgactctaccaaaacactctaagaactaataaactaattcagtacagttgcaggatacaaagtcgacatacaaaaatcagtgatatttctagactccaataacaaactagctgaaaggaaataaagaaggtgatcttatttacaatagctattaaaaaaaaaaaacacctaggataaatttaaccaaaaaagtaaaagacttctatgaggaaaactataaaacactgatgaaagaaacgaagaggacagaaacaaatggaaataatcctatgctaatgaattggaaaatggaatactatgcagccataaaaaaagagtgacatcctgtcattcacagcaatatggacaagtctggagaacattgcattaagcaaaacaaggcaggcacagaaagataaatactgcatgttctcatttatatatgagagctaaaaaatcaaactcatggaagtcaagagtagaactgtgggtattaaagatgataaggaaaggttggctaacaaatacaaaattaagctagataggaggaatgagctctggtgttctgcatcactgtagggcaaatatggttaattataatttattgtatatatttaaagagctaggagagaagatttttgatgttcacaacacaaagaaatgacaaatgtttgaggtgatgcatatgttaactaccttgatctgatcactacacattgtatacatatatctaaatatcactctctgtaccccacaaatatgtacaattattacatgtcaactaaaaataaaaggaaaaacaacatagatggaatcattttaacagataaaacttgagaataaaaataatcataaaggaaatattgtaatcatcacatctgattcctgtgtctatctcttagctggttccaaattaaaaacaaaagtaaaggattgtgaattattgactcaaactcaattatattattatgtttattttgcaaatgagaaaactagatttgagagaggatgagcaatttacccaaagtcaccaaaatctaaagtatgtggcaaaacaggcagtcaaacagggacccctcattaactcagaagtctacattttttctcacattcttatgtgcttgtcacttatattcattaaaaacaggcacattccatcaacattctctagtaagagtctaaacaccccgtgtaagatacagggaaggaaaaggaaatggaactcacattttctgtgtatctattatgttccagacactgtcctaagccattatttacaatacatactttaatcctcacaaacacccccaggaacctgcagcaagttcggtgagaatcaggtatccaaagctcatgtgcttttgatttactaagttgcttttgaagaccaaatattagtcttccaaatgatcaggctattaaatgtagtgtgtaaacaccaacagcatcagtgtatctgcttgattcacacacttactgaacagttctttacgatggcacagaacacgacatccacacataggaacacccctgtccggcctatgccggcactgcagtgaacaaccatgggtcctgtaaggtggctcttccttgcataacgaatatattttatgaagctatctgctgaggcaggagtgccatggtctggccacttggtgaactgcaactgttttacagagtgactagttcccgtctgttagagaaagaaacagagcgagaaagacatttattgatttcttatattagagacctcacgccaacttctaatattcaaatgataataataatggctatatggtattaccttggtattatatagaactttcaaaaagtactcaaacctctttttgatgtttataagaattctggaagttgctaggaatagaggttttctccattttacaaaggagagcacagtaacaacaataaaaataccagtattaacaggcaacaaaaattaagcacttgctatgtggcagttactatgctaggggcttcacatgaattctctcctttaatcttcacatcaaccatgtgagataggcaccattttatctccattttacagatgaaaatttaaggatgagggggacgagagatgtatgctaggtcagaaggttcacacgtttagagctggaactgtaatgtaggtgtcttgaattctaatctaccatcattcttctgtaccatgaggctacaggaaaaccaagatttcaaaatgcttagagtgagagatggactgtcatgttaggaataagaccaaaaggcaaagtatcttagtttagaaatgacatatgaaatttaattaagacatataggtgtctgacaagagaggcaccgatctcttccagcgatgaagacagggtagtcaatgaccatgagagtagattgtgggtcccactattgtgctgagcccccttgaagtggagtcatgaaactcttcccagcattgtcagataaagcactttgaatttacctatatctcatccaaagggatcatgaccctttcctcagtgtggggcccttattttatcacacatgggaacctaatggaagaactcaaaatgagtttctcacttctcctatgcttctcccgaatgcacctctttttcctaagctttctgaataaagatgctagtgctcagagctctattctaatccacagtgtcgactgaaatttgtgatagttaattttatctgtcaacttggctgagccctggtatccagatactaggccaaatattattttgtgcctctgtgaaggtattttttaggtgagattaacatttaaattggtagaatttgagtaaagcaggttattctccataaagtgggttggcttcatctaatcagctgaaggccttaagagaacaaaaactgacctcccatgagcaagaaggaattctaccagcagattgcttttggactcaaactccaattcttccctgggtcttcagcctactttcccaccctgcagatttgccaaccctccacaatcacttgaaccaactccttaaaattaatctctctctctggatcagtcccataacctgtattcagggatctcaatgttatactgctagaaaaatacacataatcacatattttgttgctactacaaatgtatgggtcaaacctcagcatcactcagcaacccttttcctggtgattgtgctccaatcaacttctttggtgatgactccaaaactcaccattctctgcaagtttcctgttcaactcctattcccttcactcttgttaacacatgtatcacctacctgccaactgaatccactagagcaatctaactcattgctttctcctataaaccattccttttctgttttctaagtctattagaccaaggaatccatgaattattctagaccaatgcttctcaacagaacttcctatactgaagcaaatgtcttaaatagtggcaatatagtagccactatcaacatgccactcataagccctaaaatgtggctacttgcaggtgaggaactcaatttgttattttacataaatttaaataacttaaatttaaacttaaatatccacatgtggttactgtattgaatatattttcaacccctcctctgtcacttataaatcataagtcataagtcacatatgtctcccaattttatctgcaaaacacttgcgtctgtgctttccacccccatgccaacagccgtagttgatcatgtcacttactaaaattcttcaatgtctcccaattatcttcataataaagttcatgctacttagctgaaatttaagacatttcacattctagctggcccctgcttacttttgagaacctcatctcatcttttattactccctggcactgaacttttacatttcagaaacacataactacttatatttgtctctacacacaccttatgctattttatattttgatcatctactttctccctccatctttttcatttgcataattctcaaaacaaatgccacctcctccagtaaacctgtctcaaaaccccaagtaaagccaagtgtttaccttctgagccccaaagtgcccaagacatatctcaacattatcactgaacacggtaagttaggtatctatcagtgagtgtaaccaacctctccactattcggtaagtactgatagtgcctggcccagtgattagcatactttaaggactcaatacgtatctgctacatttggcagaggcaggtataacccagaatcagacaacttcaacagtcactctccctgccccacctctcttttccaattttttcttctccacagaatctggttgaggagaagtagaagtggtggtggcttctggtaccagggacaagtaaaaagttacttaagaagtatcatcgatcgattttccatcctactcctaacttctagttctaagacatctgcttatgtggtgaaacatatatctaatactgatgtttaaaaacttacggacttctccacaacttgaaacattcgaatgatgaaatattgaagtatctggtagttctccaggaatacacggaagtgtttcaattccaatggcttcttcagagaaatgggccagtaatggtagcatttgataattccaccttctatctctctggttatcatggcaataacatttgaattattttccaacaccatttgccaaaagtcatctatggtgctcagcagtggtccttgagtagcgatataaaaatactcttctccacaattgactattctaatataactagcattgatgtagtccttgctttttccaagaggaacgcgtgttgaatcatctattacagaaacagaaacatctggtagataaaggtgggagatacatcacacccagacttcacgaaaggatttcacacatgtaaatccatatatctctttgaccaatagagaagatggcctaggagtttcttttcaaaatggttgagtccatgagtttaaattatttcctccctgaaaactattggcatgacctaagaaatatacaattatgggatgtttatttttcaaatcagtttttaataaatgcagaatgatatcattagcatccaggtacttttggaaatttctgctagaagtggcatgggcaaggttaagtcaagggaagtatcctatagtttgcaactgaacacaacagaggagaaactctttgtgggagtaaatgagtgatattatcctgcaaatctgaaacctgcaaacccagagcagcaggagccaggggaaaaaaaaaatctgatagttgactgcagacaaattctaggattaatggaattccaccactgtccccaaactagacagccatattttatgtccattctcagccttcatctggtgataggacatgttattcaaagcaaagatattgtggcaaaaggatgctaccaaggggaattgctccaagtaatatgggactcatctaacatggactgttataacaaatacgagagggaaaaccagctatttggcctactaaccttcactgctccaggagttccttcttcacctgacacagacatctgaagctctggttccaccaccatccccacagtgagagcagaaacacacacagcaaaggaggcccttctctgccatgcagctctctcaccaataacctctccttactactcagaatcacatggaccacttatctagtaaatatgctgacaagacctgaacaggcatttatataatatctggcagaactcttctcaaattttaacatagcacacagaaactttcccttgtaaatatgaatgaacagaaaaaatcagccaggcgcggtggctcacatctataatcccagttactcaggagactgaggcaggagaatcgcttgaaccagggaggcggaggctgcagtgatctgagaccgcgccactgtacttcagcctgggtgacagaatgagtgagactccatctcaaacaaaaaaaaaaaaaaaaaaaagctagatatataaagatacccggtatttcaaaaagggagaccattctaaaaaatcacaacaaatattctcctttctataaaagatgataacaccttaaaaactcctatttgtatattaaataaaattcaagagagcattaattatttaaaacaatactttatacctatgtttactaacaaatatgttatattactaaattataaaggtgataacaatggctttgtagggagatctttcatcatatttatgtagatatatgatgatatatgtcatataataataataagcctggcaagtgttcatcacaatgttagcagtagttattacagtatctaaaccatataaattacttcatagtaaaaaaagcattttttaaattttgaaatgagattaaatatgtgaaaattaaataatctaaaataataaaagcttgatttcatataaaagtcacaatcattcaactcaaactcctaaagcaggaattgaacagaaaaacaaatttatgtttagaaaatcagcttaaaaaattttcccagaactcagaaaaaaaagattaaaaaaacctacaataatgattaaaatggtaaaagacacagcgcatacaaggggaatgtaaaaaacgaatttcagaagcaaactgtggaattcactgcagaaaagaaataattcaagtgatcataggaaagctccctaaacagaagcaggagtactaacagaatgcagtgaaacatgcataccaggttcaagcagcatgatacgctacatgtatcaccttgtcaactccaaaacaaacctttgagggaggtgctattatattcatacttttcaaataaagaatctgtacaaagtaacttgttccatattatgcagcaatcttctagactccacagactaggtaaatctagactctggtccaaaaataattccatgctctgttgtccatcaaggaagactcaagtttgcagacagaaaggcctaagtgtcagacaacattaatgaagagagccactaagacccctagaccagcagagcataaggccacaggaacaggaacaggaagcaaaaattatgctaatggatgactaggggtaatggcaactggtgccactcccatttccaccccttgattcttgaatcttggctatggtagaaacagcatcatatattggatgctgacatggggcatgtataatctcctgaagaacattaccccagccctgcaaggtactgccacctagctttcactgtaattgagtcttcaaaaggccattcatccattctgtcaagccagccgctttgagaggataaggaatatggtaacatagtggcaatgaggccattgccacaaggtatttgccacaaagtgagttctttgattacagcaatgctgtatggaataccatgatggtggataaggcattctgtaggtccacagatggtaaattggtgggagcactgtgtgcagggaaggcaaatccatacccagagttactgtctattctagtaagaaaaaagcactgctccatgcattatggaagtggtcccagtgtaatcaacctgccatcagctagctggctgatcatcccatggaatagtgcccatcaggtactcaatgttggtctctgttgctggcagattggacactcagtagcagctgtagccaggtcagccttggtgagtggaagtccatgttgctgagctcatacataacttccatccctgccattatggccactttgttcatgagacctatgggcaatgacacaatgacaggggtgactgggggtatagtctagctgatattcatagagcatgtcactctattcacctgattattaaagtctgcccctgctgagatcaacctttggtgagcattcacatgggatacaaatatctttgtgtttgtgcctatctagcaagatctattcacgtgcctcttccccagaccttattgtcaccaatttttccaaccatgttccttcaaattccctgaccatccagctaagccattaaacatagcccatgaatcagtacacatttatacgtctggccatttctccaagcaaaaaacaaaaaaacaaaaagcaccaagtgcactacccaatgttctgcccactgggagttatttctcttcaccactgtccttcagagatgtctcaaaaaaggggctgtagtgctatagctgtcctcttctggctggtacctttatatcacgcagaaccttctgtagaccaggtccaagtcttctcttcttctgtcagctgatcataggcaactcctcatgagacaacaggtgctggctgaagagagcaggtaatgtagcaggggtgggaacagtgagcatttgggcagcttcttcgtgtaacttatttgtgccttcaggatctgctcaagcccaatgttgtatctaccactttcatttgatggtggagtgctgctgtgtatgcccaactttatggcttggtggcccatagttaagcattctctacttagttctctatgaagcagtctctaccaaggcccagtagcaggccaaaagctgtttctcaaaaagagagtccagagagggtggcaggaatttgctctaaaatcctacgtgcctgcactgtgattcatctaaaggggtctgccaaaggtccaaacagcatccttatctgccaatgacacttcaagcaccactggatctgctagatcatacagcccacgtggcagagaggcttgcatggcagactgatcctgtttcagagccttctcttgttttgggccccactcaaaactagcagcttttcacatcacttagtaaatggaccagagtagcacatcaaaataaggaatgtttcctccaaaacgccctggttcactagccattgtgcctcttttttgcttgtaggaagagccagatacaatttatccttcaccttatgattatctccacatgtcccacaacactggacctctagaaatttcactgaagtagaaggccactgaatttttgttggatatatctcctaccctctgacagacaaataagactaaagcatttgctacttcttgttcactagatccaatcagcacaatgtcatcaatgtaataaacctctgtaatatcctgtggaagggaaaggtgactgagatccctgagaactaaactacaacatagggctgaagagttaatacacccctgaggtaggacagtgagggtgtgttgttggccctgccagctgaaagtaaactacttttggtgttcttgattaataggtatagagaaaaaagcatttcccagatcaatagctacatagcaggtatgaagagatgtgctgattttctaaggcaatgaaactatatctggtatagcagctgcaactagagtcaccatctgaggaagcttacaataatccactgtcattctccaaattccatctcttttttgtgtaggtcaaataggtgagttgaatgggatgtgatagatatcaacatcacttcatccttaaagtccttgatggaggcattaatatcagcaatctcttcaggaatgtagtattgcttttgcttttttactattttcctaggtagaatcagttctactggcttccactggccctttcctgccataatattcctcactccacaggtcagagaagcaatgtggggattctaccagtttctgagtatgtttattccaattattcattccagggcttggaaaataatcacaagatggttttagggacctactgagtccactgtgaaatgaacttgaactaaagctccattgactatctgacctccataagcccctgctttgatttgtagaccacagtgatgttttgggtctcctggaattggtgtcagttcagagccagtgtccagtagtttctgaaagttctgactattttctttttccaaatgtacagtcaccctggcaaaaggctatagatccctttggagaaggctgaaagattaacagtatacatttttagcagtgtgccagggtcctccctttcattcaaggtgttctctgtgtgtaaactggctcaagtctgggaagttattgactggttgtgattctctgttcctatggttcaggttagaattttgctcacttgacctagaactcttctgcttacacctatcaaggaagaatttagtagacgtcccatctagttcacttctaggaacaccatgatcaactaatcaacaccacaggtctctacaggtcagactgttctgattgctgctttgactctgctattaccataccatgctcaccttgcctttggctatcaagtgccaccacctggcccttatctctctgggatccaattatacccactgcattcaggtttcccaactcagtggcagcaatttccactgcaatatctgaactacagagaagaacaatcacagtattcttcaaggattctgggactcgcctcacaaatatatttctcacagttatgagaaaagtacatcctctggacctcctggggtgggttggcaggtcttaaatgataaacctaatctaatattccaatctccctaatcctttggatcacagtatatagtatatcgaggcagttctggcattttatcttcatttagactgggccaccttttggtccatttaatacaaccaaccaaataaactgtaagagctctttctaactccctaatccacatattaagtccagaatctcttctttgtggtcccatttcaataaattcagcctgatcaaacactaagttccttccaccattgtcccacacccttaaaatccctccccacaaatatttcccagatttctgtcagtataaattggaaaaatcatgtagctcttttgtagcgtaacatacctccccatgggtcacactttgtaccttacctttaagggcctgctgggacttgagtctagttataggtctagaagcaatgaaggatggtagctgtgagtcttgagaagaatcagcaatgtcttgcaaggcaacaaactcaggggaggtaataaaagtttcctcaggtaaagtagcatcaatctcctcagatgggggtggcatggctgcttttactggcaaggaagactcatcagggtcaaggggttcgatacacccagctttataaggctcttcacatatgtctgcactccagttttcaagatcccattccttctcagttaatgccctcattttaacagcagacaccctaaaagggtggggattcaatttgcactgtaattcagccattttcaggatgagattttgggtttggttttcaataatctcagctttgttgttataaaatataagagtttctttcagggcagaaagagaaacttttgggttattcatgcggcacttgagctgggaaatttaatccctaagatcatcctttccttctctacattaggagtaactagccaatctcattgttctcatgagaactcaaaaatgttctaaggtatcaaatacagatgcccagaaccttgcttcttgtaaatgtctgaataggattacctaatggcaatactttgcatatctctactgtcacattacactatgaattattaatactctattcactactgaaaagtcattaatgcctttacatcttatcagattagggaagtaattcataaaactcatccttaaaattctgttcctctagaattgctctcagtaccaaattctgttactctagattctctagataaatagaatcaataggctgtatatatacagtgagaaagatttattttaaagaactgactcatgattgtggggactggcaagtcaatatctgcagggcaggccagcaggttagaccccagggaaaagttgacattgtagtcttgagtgcaaaggcagtctggaggtagaattccttcttcctctggaaattttagcgtttttttcttaatgacttcaactgactgaataaggcccactctcgttatggaggctaatcagctttactcaaagtctgctaatctaaatgttaattacatcttttaaaaaataccttcacaccaacatctagactaatatttgaccaaatagctgagtatcatagcctagcctagttgacacatgaaattaaccattaaacaagctaaaaattttagtagatgatttgaaggaggaaattttttaaaaacttatattagtttcctataaaaccaagtgaaagaaaaaaataagaataaaaatgagagagagagagagatagagaaagtacttgcaaaactacagaggtaaaagaagtaacgagaaaaggttttataagatagaaccaagaggcaaccctaaaattcatagaaactaaaaaaaaaaaaaaaaaagacaagagtagactgaagagtagaaattacaactaaaggaagatcaattaaagggtttatttgtctaggtaagaatgatggaaatgaagcatacctggtaacattatttaattccaggaaaatagttaaagattttgaaataaaagagcatatttctcatgaagaaaaggagtcagatggccattacagttctcatctaaaacactggaaggaagaggacagtgaagtaacactcagggaaaaaaaatgagaaaaaaaagaactaaaacccaagattcctaaaaccaacaaggatattcgtttatcaggataaaaaaaaaaaaaaaaaaaagtagagcttgagactgcatcaactacttatacccatctccaatcaaacaattaattcatcagaacagtgatttcaaattaagggaaaagggaaagaaaatgaagtaatagcaacaaatactacaaaacatagtttcatatctataagaagaatgacgagagccaggcattccagctacttgggaggctgagacagaaggatcacttgaagccaagagtttgagaccagcctaagcaaaagcgtgagtccctgtttctaaaaaaaaaataaatgaataaaaaattagctgggtatggtggcacatgcccatccccatagtcccaactacttgggaagctgaggtgggaggattgcttgagctcaggagtttgaggtttcggtgagctatgattatgctactgcactccaagtagactctgattcttaaagaaacaaaacagctctgtgcggtggctcatgcttataatcccagcactttgggaggccgaggtgggtggatcacctgaggtcaggagttcgagaccagcctgaccaacatggagaaaacccatctctactaaaaatacaaaattagccaggtgtggtggcacatgcctgtaatcccagctactcaggaggctgaggcaggaaaatcgcttgaacccaggaggcaaagggtgcggtgagctgagactatgccactgcactccagcctgggcgacagcgagactccatctcaaaaggagaaaaaaaaaaaggtttcttgaaataggaaagaaaacaatgtacaataaatacagtggtggttaggcctgggtttgaatcccagatctctctcctatttgcagtgtgaaagtgagaaaattacttatctcttttagcctttctgtaaacaaggacactaacatactgacaccttagaggtaggttgttgtggggattaaacattactacctataacagacttaaattagtaataagcaatagtaataaacatattagtgttactactactattattattagtgggtggtagtagcagaaacaaacatagagcaacctcaagaagtacagaaagaagcttgttaaatctctgccttgaagagcttgttttcccatctatctatattataatgctgaagtgtatgaaaattttttaaaagtgtaatataccttttgcactcacaaaccacctttttaacagtttatggaggtaaaactgtcatacatgtgcacccatgagaccaccaccacaataaagataattaaacatctccatcagtgcaaaactatcctcatgcctctttataatctatccttcttgctctcatcttgccccaaggcaaccactgagacgttctgtcaatacaaattagtttaaattttctaacattttatatatgtggaagcatacagtatattagttttctaggtttgaaatttattttcacattctggaggctggaagtccagtattgttatggtttggatgtttgtcctctccaaaccttatgttgaaaactgatccccaacattggaagtggggcctaatgggaggttttgagtcatggagacaaatcactcatgaatagattgatgcccttcctcagggttgagtgagttctcactctattcactgctgcaaaaaccgattattaaaaaggaccaggcacctctctctctccctcttgtgtcctctttcaccatgtaatctctgcacatgctgattccacttcaccttctaccatgagtggaagtagcctgaagccctcactagaggcccaatcttgaaccttccagccagcagaactgggaattaaataaacctcttttatttataaattaaccagccccaagtattcctttatagcaatacaaaatggaataagacagaaaattggtactgagaattggggtgttgctataaagatacctgaaaatgtggaagcagttttggaactgggcgatgagtggaggttggaagtgtgtggaaggctcagaaaaagacaataatatgagagagtgtctggaaaaagtgcccaaaggcacttcagaaatatttggggccaccccttccctaataggccccaaggccttctggggacagacctggagcaccactgcccttggccacctcaggatgctgctccccacatcctggctgctctggctccagcagtgggtcaaatggccccaggtagggtttgggccactgctcctgaggggctaagtggtaagccttggtggcattcatgtggtgttaagtctgcaggcatccagaatgcaagggacatggaggcttggcagctttaacctaaatttcagagaatatattaaaaagcctgggaaagcaggcagatgcctattgcaggagtggagccaccaaagagagcccctaccaaggcaatctttagtggaaatgttgggttggagtttccttagagtccccaccagggcaactcttagtggacccacaaaggtgctggaaccccacaatagtagagctatccacagcattccacctcagcctgaaaaagctgcagcattattacaacccatggaagcagccagtggtctacgcccagcaaagctatgggggaagggctactcaaggccttgggagcccaccccacacaccactgtgaccaatatgtaggagatagagtcaaaggagattattttggagctttaagatttaaagtgtgccctgctgtgttttggacttgcatggggcctattatccctttcttttgaccaatttttcctttttggaatggaaacatttacccagtgcctgtaccaccattgtaccttggaggtaaataatctcttttttgattttacaggcttacaactggaaagaacttactttgagtctcagatgtgactttgaacttttaagttggtgctgaaacaagttgacttttagggactattgggaaggaataattgtattttgcaatgtggtaagaacataagttttaaagggccgggggcaaaatgctatgatttagatgtttggcccttctaaacctcatgttgaaacttgattcccaatgttggaagtggagcctaatgggaggtgtttgagtcacaagggcacatccctcattaatagattaatggcaggagtgagctctcactctattcgttctgcaagagcctggtacctccccatttctctcctgcttcctctctcaccatgtgatctctgcatatgctggttttacttcactttccaccatgagtggaagcagcccatagccctcaccagatgcccactcttgaaccttccggtctgcagaactatgagctaactaaatccctttccttcataaattattcctctatagcaacacaaagaaactaagacaaagatcaaggtggcagcaggcttggtttttcctgaggcctctctccttggcctgccaatggctgccttcttgctgtgtcttcacatggacctttctctgtgcctttgaatccctgatgtctcttgtgtgtcccaatttcttctttatataaggacatctgatggattggattgggcacactctaagaacctcattttatattaattactactttaaaggccctatctccaaatcaggtcacattctgaggtacaaagggttggaacttcaacatacaaattttgggagaatttaatttggctcataacacacagtatatactcttttgactggcttatttcactgagtaaaattattttaagattcattcatgttgttcaatgcattgttagtcattttttattgcctagttgcattctattatgtagacataccacaatttgtttattcactcttccgttgatgggcatttgcactgtttccagtttttggctattataagtaaatctgatatgaacattagtatataagtctttatgcagacatatgctttaatttctcttaggtaaaacatatgaatagaactgctaaatcatatggtaggtacatgtttaactttattagaaacaaattccatttcattgcagtgagtgtaaaatggtatctcattatggttttaatttgcattttcctaatgatttacaatggtgaatatcatttcatgcatttatttgccatccttatatcttccctgagaagtgtctgctcaaattttttgctcatttagtgttgggttatttgtcctcttcttgatttgtagtaattatagattataaatataagtttttgtgagataaatgttttgcctgtatttttcttctagcctgttgctttcctttttggttttataataatatgctttgaagagcagggttttttttttaatttgatgaagtccaatttattttttttcttttacaatttgagggttttgtgtcctatttaggaaaaatttgccaaagccaagggcagtaacgttttctcctagggtttctttcagaagttttatgtttttaactctaatgataggtctataatctattttgagttaatttttatataagttgtgaggtaagaatcaaagttcatttttggtacatgaatatgcaactgtccagatgatttgttgaaagattatcccttccttattgtcttgcattaaatttagatattatcatcttctctgttcttctcacatgatcatacagaacactcaatgagaaatatataagcatgctctgaaaagtgagaagctaacagaaacctaagtcactaccttgattagttctgaataggtccctgatagataagtaacagaaaaaatattaggccaggagttggggaacctctgtgactcgctcttttattagccttcaaactgctttgtaagttgtgaaatggtaaagaaatggaagatattgtctttatacctaaaaattcctatactacataataaaggccattcttgcttggcatgatggtacagggccataaatatgaccatgcaagttgaaaccatgcgaaaggacctttgttgttgttgttgttgttgagacggagtcttgctctgtcgcccggggctggagtgcagtggcgctatctcagctcggctcactgcaagctccgcctcctgagttcacgccattctcctgcctcagcctcctgagtagctgggactacaggggcctccaccacgcccagctaatttttttgtatttttagtagagacagggtttcaccgtgttagccaggatggtcttgatctcctgacctcctgatctgcccgcctcagcctcccaaagtgctgggattacaggcatgagccaccgcgcccagtcacaaaaggatcttagtaattaataggaaatattattcttgtttcatggctcttaacattttttgtgaaatcattaaaaactcacttattgctggctatacatatatagagaagcaaaaaatagcaagactaatatttatttagaacattgtaatttaaaacattagaaatattgggaattaaagcatttaatttgttaaaaaaaaaaacaaaaaaacaaaacttacccagagtagtttgaacagtgtttgcctcttctttttgttgtataacttacaatacagagtgagcattttttctatgtctaggctaacttccaagtctggatcagtttccaccttttatccttggcacttatattgttgtgaaatagctccaaagtttctttaatgtcaagttttctaccatcattgcttcccctaggttgcctttatccttttcctcacaagcactttggtcattcatgtcggtaagttccccttccacaggtgccttaggctgcagctctagggtcttttgagcagtagcagtgtcagcatgtccctggtcagctagttcttctataactccattcaaatttcatttccaacattatcactttttatccctttattgcagtttcatctctctcagccaaatctctctcttgattatacattttggtaaaaggtcataggggtttaccattgagagacaaggagacaatacaatcacatgctttgctgtgtgtgaactgaataagaggctcacagttacctatcactgacatattttgaaagaagtaacatttattagtcactggtcatgatgcacatctgttatttacatagggacttgtggactaaagtgccagcaaagatgcttactactttaggcaattacttgcagtgaatatattgtggtaactaaaatgtgaattgtactgtgggactggtgttatttagctaaacacagtaactgatatttgagcatattggggccatgcaaagtgaaggttccctatatttgcagtgttcaaaggtgtgtgaattcatctatttagtgttctcagcatttgaagacgacaaataaattacttctttagctttcttaatatgagtcttcaggaaccttttctataaagtcaagaaatgtgtgattaaaaaaaccacagagctttctatgatggccacttaagttggctgagtttcagattagattacactgcgttatgaggtagatataccaatgggcctttaaaaagaatatggttgaattatagtttcttttcttttatgaaaagccaaaagttttacataacttcccttactttaatgatttaacattatttttattatctttgaatttcttagttgtaactcttttgatatccagaataaaaacttcaagtcagatcaaatattatgtgtaccttctattgtaaaatgagcttcttacaatcccgagaggctaatttttaaggcatgtttgcttttagtctccttgagggcaaactgcacatgcagaaatagaaattataaaatttggacctttgacattttggagaagcaacaaattattagtattatttattaaaatgtctaatcatggttcattattctgatttcagaagtattcatcaatgcacttctccacactctccccacagaagataacagaatagcttattttaaccatgttggatatgtacttgttttttatcatcataaagttagtttcaattctaataaaccaactaaacatgaaggtatttatctagtgaccgcagtcactgtgttccactctggtttttataataactatctcaagtctagtaggagaaacaaaagtgaaaataattaaaatatggtttggtagaaggggagagtggttacaagatgctgtgagactactggaaaaacaccaaacctagctttgaggaaaataagaaaagcctattggagctggttaagaaagatagcaggaactgcctcagcaaagaagggatgagtagttctttcaagaactgcaggttaagaggcataaaaaccaacaaataagaaaagaattatgaattctagataccaaaagaagttttgtgggagagctaaggctagagaggcaaacaggtgaaattcttaggccatgttaaacaactgtaccatgatagtaacaaagagccaagaaagagctttaaaagaagagctacatgttctgacttgcattttaagaaaatctcagtagcttttgtgaatgatcagaaagggaggcagtaaagaagaacgtaaccagctgagaggtaaaatgggctcagtctaagtcagcagcagtgggaactgagagatgggggaggaccccagaggtattatggaggtagaatcaactgactccctgttttctggtttgaacttggtgattacataagatatagaatataagaagagggtcaagttggaggaagtaaaatagtaaatttagttttgaaaaactttgactttgaaaggaatgtgagttatggaatgagatatcctgcctaagattaaaattgcattgctgtgttttgattctgctctttgaatggcctgagatggataactcctaagagtaactgagtgaggaggacagaaggtgccactaccctcccatccaacacagggaagcaacgttaaggctctgtggagacaatcaaaaggcagcctcctgttggagagcagattagcagctttattgtccaggatgaaggatgcaaatagctcttttttcgcgtgtctaaacaaaatagccagagaaggtggttaaggcttcgggtaccaaaagtggtgtatgactcagactattggattttatgttttggaaggctcatgctctgagaagcagcaatatatgagaacaaggctgaaggactgctgtaaaggaccctgtaacagtggctgaaggatgtaccagaaaacagaggacctgactctctcatatctagcacatatcttagaatatgcccagatcacccagtgctatgtaccagaaccctttatcatggtcacaggccaaaatgtctcatacaaaaagccatacagtgccctttgcactttttctaaatataaacaggaaaataatcaaaactatttttagcttacatggaagaatatctcggtatctgtttttttctctgttgcttggttgattcccagagttgaactcaccaggcagattcttaagttctaaagcctttaaaaggttaaaaatgaataaataaataaataataaattgtgtatttactataaccaataaaaaagaaaaaaatatgcctttgtttagtgctcatgatccttaaatccctatatgacatgacctgctatttaatgtgttgtatgataagtgaagctagatcctcatttaaaaagtgctatataaaatatctcaagtttcacatgccaatcaatgagttggttaataagaaaatgttaaactttctggagatactttccacttgaacttcattttcttcttctttcataaaaaaggaaatacaagctattcatttctcagaacctacccacagatctatcattttataaataaaaataacaacataacaacaacaaaaacatataaacaaaaaatatatacaaacagtctcacaatttacccttcccctttgaagaaattatagttaggaccctaagaatccttcctttcaaaaaatttctttaccaagtgtgaattcaacaaacacttattacacatttagtaggtacctggccctgtttcagacactggaatacagggatgaattggataatggcctcatccttaaggagtgaagagagtagttagaggacatgtaatcaaataccatgtgaccaatgtacggagacagtagtataaatgacagcactagattgcacctaaaagtcaagaagaaaagctcctcaaagggaaatagcccttgaactgggccttagtgagtcactggaagttagcatatgaaaaacagtgtgtatttagaaggaaagaggagagaaggtgaaggggtggaaataatggaggcatacatgtccctttgggaaactgtgactaatatggtaataagagcacaaagcacatgatctagtccaacaacagactaaaactataaaatatcttgtttcatatataaatgaaattaggaggtagctagtcatactttattagaatatttgtggagaaagcctgaaaatctatacattttcaaagctcttgggtaactcttgtgtagccaacctagcaaccgctgccatggggaacaaggagcctgtgaaggttttaagtagtacaataaaatgatcaagtctttctgaaaatcaattttaaaattaatctggaaaaaattctgtaggaagaatgagaaaaaattcatttatgaatgaataatgatggcagatgagtctcattagatgttaaaagataatatgaagctatgctaattaacagaacaataccaataaaggaataagaaaatcagtagaaaaagtccaagaataaattaaaatatatgtaaggctctagtatatgataaaagtggcattttacctcactcaagagaaattccaggagagtcttgggacaactggatagttatataatgctgagtccctatcaaacatcttataccaaattaaattctagctgcatcaaagatttaaatgcttaaaaatcataaaggtactagaaaaaaacatgaagtaattattacaatcctagagtaaaagaagcattcctaaagagcacagaaagccccaaacccagaagccccaaaagcaaagattgccatatttgaccactaaaaatcagctatttcttcacggtaaataggcatgtgtgtgcacatgcatgtgcacctgtgtgtaacacaaacaacagcagaaaaaatactacgtgtaagacacacaaaggcataattttttccttaaagagttagtaatcggccaggcgcggtggctcacgcctgtaatcccagcactttgggaggccaaggtgggctgatcaccttaggtcaggagtttgagagcagccctggccaacatggtgaaaccctgtctctactaaaaatacaaaaattagccaggtatggtggcaggcacctgtaatcccagctactcgggaggctgaggcaggagaatcgcttgaacctgggaggcggaggttgcagtgagccaagatcgcaccactgcactccagcctgggggacaagagcaagactcatctaaaaaaaaaaaaagagtaaccaataagaaaaaaaaaaaaaaggaaaatggggcaaagaattgaaactagcagttcactgaaaatataaaaggcttaaaaacatatggaaagatattcttttgttctcaaataaataccaattaagtaatcaataagaaataatttgtcatttaagagatgagaaaagatccaaaaaattgatagcccaaaatattaatattgtctttctaggaatttgttcaaaaaatatttaaatatatgcatacagtatatgaagagagatgaccgctgttcataatagcaaagactagaacaacctaaatgtccaaatgttccatggtagttaattatatggataagtaccctaatttcagaaattaaatattaaataaattaaggtacttatccatataattaccatgcaacacttaaaaaaatgagatactgctatacatgctgataatatacttggaaattgtatctaggaggaaaacaaatttaaggatgtaaagtgcattccgacaaatttttttaaaagtttgcatgacaaaatgacaaaatgaatagtgtaaaggggccctagaaagtcttgagagaaagagagagactttctattttatatccttttatgctatttggctttttttttaaccacgtacatctattactttaaaatatatataatatttaaaagtaaaaacaatgtactagaaccaaataaagaaagaaaagaaaagaaaccctctggcaatgatataaaaaaagaaatcacatatagactttcgttaagaaaatatttaccataaattcctgcatgatatcatacgctgctgttttttcctcaaggattttcaaacaatccttgatggctgtctgctcatgaaaattgaatattaatggccgaatctgagccaactgatctagttctccttcagaaacaattttgcgcgtatctaaggaagagaaaaattcacatatgtaagttactggtatatatgtgaagggagattttatttttgtttctgtttctcttaaagacacagccatttaagggtaaacagaagtttatttttccacgggtgaagagtctactactttgaaagaggcttcctttggaaaaatcatggctatttacaccttgaaattatacaaaatccactgcccttggagaaaactgttcagtgccataaacataacgaatgctgtggattgagaagtgttcagttttataatgtgaattgggtatatggattgaaaattatgccaaggcaagaacgtccaaggcttggattaggaaagagaacttttgccctccctgggaccaagtgtttggaagttcctagagtctgagatgtggtgacgtggagagttcacgtcctgtttcattactctgaaacagattgaacatgaacgcacacacgtgcacacacaccaaggatggagaggatctatgcaatataattaataagatggaataatggatacgtatggacacttgcaaccaataattggggagaacattctattaatatttaatagcacacatacaatctttttatttttaattatgatcttttaggtaatgttgacagtcaaggttccaaacatctgaaattttatacattatgtccactggccaaaatgcaataaatctagaagtcaacagtaaaagagtattttaaaagcttcaaaattttgaggtaagatgttcaagtaaaacaagttctcataatctctttgcaaagccaaataatgtgaacaataatcaagttaataccagcaaaaagatatatacaaaacaatatagcaaaagaaagaggtggaaatttctaagaatctgcacattcctgggaagcacatcttatcttggtactccactatatccagaggctctttgtagggttggaagtgagggctcttggttgggatagacaggcacagaaatcctaaaatttctcacaaatatccctaaccttagtatgagaggaggtctaagcaggctggaaggggagataaaattcccacaagcgtagaagccattttgatcatctttgatgcccaacagaaaaacccttagatcttcccattgtgttccacctttgctagtacaaaagctgggagaatgaagagagaaaaaaatgaaaatgtagaatgactgtaacaaacactggtgttgactccccaacactgattctacccctctggttagttaaagccatttgtgatcattccatagtaagatccttccagtgaataattcagaaataggtaggagatttgcgccaaccatagaaataggctggtcttgtaaaaaagagaagcaaacctctcttctaccctcatccctctgtacagacataaacaaagaagtataaggacctaattatcatagtctgccctcttatggccataaaaggaaagcgtatagcaaatgtgaaaaacataaagaaactatgttcttgatgacattagcaactgatcatattgaacctggaatccttcctatctctgggcttccattatggtagaaaatatatatatctttatcattaacatcattctgaatttggtctctttttcttgtagcctggtccaagaattccaatcaaagtataaaggtgaggtttcagctgtagatcctgggaatcatttcagccagtttacagaaagggatttgatctagctatttggtgttgtatcaccattgtgtgggcttgaagaacagatgcctctctcattatgatccaagaacaacactgcataatggtctgccaagaaaagttctgtctttgccacaattaggaaactgaggaagttggagaccattttttctagccactggctcctagatgacaccacttcagcaacaatggagaaataagaaagtcactaccacaactgttggctctagtaacacatcaccttacctataatgaggaccaggaacgccaagcctgctatgatgcatagcaataaaatggatgcctctctacacatttacatcttggctaagtgcatatgatcggcaaagcccaaataagctaccaggaagtcttgaaaatgtaatttttcatttttctgcctgggccatacaggaaggtacactaggagaagggtgtgactgatattgagtaagggcatctgtgatatctgcttaacatttcagccacaccatgccctttgagtatcctgctccttggcccctatcccttcagcacacttatcattgtcctcgggcaaaataaacaatgcagccctccaaaatacagtttacaagggaagatgatgagatccaaataaaaatggaaatcaggaagaattcattcctgctcaatcaacaaaaccgaagagacagaaaaagctatacatgttcataacaaaatggaataaaatgtgaaacacagaaaaaataataatataatatagcatgcagaataatttttaaaatctattctaaaatggaagataagcttaaaaaggaaaatgaactgtgtatgcaacatctgtcgaaagaaaaagaaaaattattttaaataagagttcacaaggagataagaaaacaatagaatgaggtttaaaaaaattagtttataaacctaagaaaataaaggtaaaactcaaaagtacataattacagcaataatttataattaaatcgaattctgcaagaaacaaagcaggcagttgaaaatcaacttattgccataggacaaaggcatgtatacatacagtaatgaagacaagaaaggtttaaaaacacagtgaaaagataatgcatgtgaggacctcatcagaggctcaggagaaaagctgcagacagggtgaggaacttgagaaatcctccttcgtggggcaagcttgggaaggggaaaaacagcatccacaggaatggcacaaagcatgcccaaaatgcttttccctatttccctaatggaccaaaagcataagaacctgagaaaacgcatgaaactctgtcatcctcaaggcacaaatgaagactcattaacattgggggtagggaagagagaagagcatcctggacccaggccataagatattccctacacctgcagaatggacaaaataataaaggaggtaccgcctgaggccttcctaagactgagactgaacaaggacagcagagaatgtcaccccaaccaggttggcaagcaaggtaatcataagtaagagctctctactgctgggaattagagaagatcatggagaagaccttctctgaggtgcatgtacaatgggaagagctaaagcagagggtggagtaaacactgaggcaaatcctctacatgtaaggtaacactggaggaatttgaagctggtggtgcactaagggtaaccatagcaacatcaaacccaagccctgctgcattactgagtaaattgatgcaactcctcacactgaaggcctaccaacaaaagagtcatgtccatccctatttacctcagcgtctagaacttagctaagaaatactacaatagctcccccttatctgcaggggatatgttccaagacccccagtggatgcatgaaactctggatagtattgaacctgatcgtcatcaactgaaacatatttttgttcatgtcttccacccataaatttaatgccttttccatcttaagtaagcatgtatcatgcactgtggccataactttggcactctgatgtgcaacagcaaaacttggatagaagattcattcttaccataggtctacgcaactttagcatatgatttttttctttccttattaagtcaagaactttcaccttttcatgtaaagaaagcactttacagcttccctttggcatatccaaattgccagcatcactactctttggggccattactaagtaaaataagggttacttgaacacaagcactgtgaggccaaaacagtagatctgataaccaagatgactactagttgactaagagacaggtagcacatagggcatgaatatgctggacaaaggaatgattcactcccaggcaggacagagcaggacagtgtgaggtttcatcacactactcagaacagtgtgcaatttaaaacttattgtttatatctggaattgtccacttaacatttttagtctgtggttgactgcaggtaactgaaactatgaagagtgaaaccatggataagacatttttacttctatctctagactatacaatattcagttttcaaccaaaaaattatagagtacacacagaagtaagaaaaagagaaaaaagttgccaagagacaaagcaatcaacagaaccagacagagatataacatatgttaaaactgtcaagtgatgaatttaaaatagtgataatcaatgtgtgaaaaggcagtgggaaaagtagacaatatacatgaacaaatggagaatttcaatggagagatggaagccataaaaataataaagtggaaatgcttaaagtaaaaaaaatattgtaagaaattaagcatgttattgataagctcatcagtagatttcacagaggcaagaaaagaattcatgaattacaaaatagatcaagaggaattatccgaattagaacacagagaaaaaaggtagatgaggggcagaggcagagaagaagagaccatccaagaactacaaaccaatatcaaacagactaatatattatacctgtaaatggaatcccaaaatagaagagaaggagaattgggcagaagaaatatttgaaaagataataactgagaattttttccaaaatgaatgaaagacaccaagcctcagatccaaaagctcatcaaaaacaatataagccagaagacaattgagtgacaactttaatgtaatcaaagaaaaaatcaaaataaagaaattaagatttcagtaaatacatgactaattataaaagctagtattcttgtaacaataatgtgtaacttcactttttcttttctacatgatttaagagatgactttttcctaaatttattagcctaaaaataaaaaaattatcataactttagattgtaaatcaacattttgttttctacatgagaaactaaagcattaaaaacattattttatgttttggaacacataatatataaaaatgtaattttgtgacaacaaatgaaagagatggggtcaaaactgtcaaaggtccacagtttttttttttttgtattttactgaattaggctggcataaattcaaattagagtgataagtttaggatgttaaatataatgcccatggtaaccacaaagaaaatagctaaaaacaatacataaaggaaattttttaagaatttaaatatttcattacaaaaggcaactaaatacaaaaggagacagtaaggcaaaaaaaaatgaggaacaaaaaagctacaagaaatatttttttaaaatagcaaaatgacagaagtctctccttatcagcaattactttagatataaatgaattaaactcaccaattgaaagaaagattggcagaatggattaaaaaataaaaacatgatccaactatacactgtctacaaaggactcactttagatccaaagacacgaataggttaaaagtaaaagaaatattccatgcaaacaggaaccaaaacagagcatgaatagctatattaatatcagataaaatcgattttaattttaaaaagttaaaaatgacaaagaaggacattatatatcataaaaggttcaatacagcaagaacatataacagttataaacatttacacgcctagtaacaatcaaaatacacaaagcaaaaattggcagaaatgaagagagaaacagttttacaataataattgaagatttcaatatcccattttcattagtggatagaacaattagacagaagtaagaaaagggaggacttgaacaatataataaacaaagtatatctaacagatacatacagaatcctctgtgcaacaacagaccacatatttaagaacacatggaatattttgcatgtgttaggctataaactaagtatcagtcaattttaaaacactggtatcacaaagagtatcttctcaaaatacaagagataaagttagaaatcaaatataagaaaaactgataaacttacagatttgtgaaaattgaacgacataattttaaaacaccaatggatcaaagaaggaattacaagggaaattagaaacatttagaaatgagtgaaaacataacacaacatatcaaaactatgggacacagcaaaagcagggttaaggggaaatttatagctataaatgcttacatgaaagaaacaaggcctcgaataaacaaactagctttacaacgtaaggaattacaaaaagaagaacaaactaaacctaaagctaacaaaaggaagaaaatagtaaagattagagcagagatcaaaatataaaatataaaaaagagaaaaatcaatgaaaccaaaagcaagttcttcaaaaatatcaacaaaatgatgtgatgaacctttaattagataaactaagataaaaagagaaaagactcaaactactaaaatcagaaataaaaatgaggacattactaccaattctaaagaaataaaaaagattataagggagtactatgagcaattgtatgcagaaaaactggataacctcaatgaaatagacaaatttatagaaacacaaaacctaccaaaaccaaaccacaaagaaacagaaaatctgaacagacctatgactagtaaggtgattgaataagttatcaaaactatcccaaaaaagtaagccctggatccaatgccttcactgttaaattctatcaaacatttaaaggagaactaacaccaatacttgtcaaactgtttaaaaaaattaaagagtagggaacactccctaacttaatctatgaggccagcattatcccaatatcaaagccagacaattatcctacatgaaaagaaaactaaaggccaatatccatcttaaacattgatgtaaaaatcctcaacaaaatagtagcaaagcaaatatttagcggcatattaaaaagatcatacaccatgactatgtgggatttattactggaatgcaaagatgacttaacatacaaaaatcaaggtaatacaatacgctaacagaaaaaaaggcatgcttatctcagttgatgcagagagagtatttgacaaaattcaacatcctttcaagaatatattctttttgagacagagtttcactgttgcgcaggctgaagtacagtggtgtgatcccagatcactgcaacctctgcctcctgggttcaagtgactctcctgctctgcctcagcctcagcctcccaagtagctgggattacaggcaactgctaccacgtctggctaatttttgtactttttctttagtagagacatgttgcctagggtggtcgtgaactccccaacctcaggtgatctgcctgccttggcctcccaaagtgctgagattactggcatgagccaccatgcctggcctatttgtttgtagaaaaaaaattcaacaaactaggaacataagaaaaatacataaacataataaaagttatgtatggaaaacccacagcaaatatactcaatgttgaaagagtaaaagcttttcccctaagatcagaaacaaggcacggatgccacttttgccacttctatttgacataatattggaagtcctagtcagagaaattaggaaaaaaaagaaataaaagccatccaaactggggaaagcaaaaagtaaacatctctgtttgccaatgatatgatattatatgtagaaaatcctaaagattactggattttacacacacatattcacacacacacagagttaaaaaaaataaattcagtaaagtagcaggatacaaagtcacacacaaaaatcagttgcatttatatacactcagatgaacaatctgaaaatgaaattaagaaaacaatttcatttacaataatatataaaaagaaataaaatactttgaaattaacttagccaagaaggggaagggaaagatttgtacaaagagacctataaaacattgctgaaaaaagaattaaacaaatatatctcatgttcatggtttggaagatttaatatcattaagatatcagtactacccaaaacgatctacagattcaatgtaatccttatcaaaatcccaatgactccttctgcagaaatagaaaaactcatcctaaaattcatatggaatttcaaaggaccccaaatagctaaaacaatcctgaaaaatatggggaaaaaagactcacacttcttgatttcaaaacttactacaatactacagtaatcaaaacagtctggtacaggcatagacagacatataggccaaaggaatagaagaaagagtccagaaataaaacccaaattattttcaaaaaagttatcaaggccatttaatgggaaaaacacagtctttacaacaaatggtgctgggaagctggatatccacatgcaaaataataaaattggatctttaccgaacgccatatacaaaaattaacttgaaatggatccattacctaaatgtaaaagctaaaactataaaactcttacaagaaagcatggcaataacttcaagacattggatctggcaatgattccaaaggtacaaacaaattttaaaaaatataattaataatactgaaatatacacttaaaatggataagatagtaaatgttatgttatgtaagatttacaacaataaaaataatttggagaaaatacctctaagtaacccacagatcaaaggggaagtcataagagaaatagggagacattttgttaaaaatgtgtagattgtattttttagaaaagttttacatgaaaaaaaaatgagcacttagaattcccatatatcccctgccaaagtttcacttattattaatgttttacatttggatggtacattcattagtattgaaccaatattgatacatttttgttaactaaagtccatcctgtattttggttttcttagatttccttaatatctttttactgtttcaggagcccatctaggataaaacattacatttagttgtcaagtctccttgggcaacttttggctatgatggcttctcagattttccttgtttttgatgaccttgataggtttgaagagtactggccaggtgtattcttcaatgccttactattgaaatttgtctaattttttctcatgattaagactggggttatgggttttcaggaataagatcacagaggtagagtgccatatttatccatagtatcaagggtatattatatcaacatgatgtatgacagttgatggtgaccttgatcacatggctgcagtagtgtttattaggtttctctactatgcagttattctttgtactcctctggccatactgtactctttgaaagaaagtcaatatgtgcaacccacacttaagaggtgggaaattatgatccacttcctttaaaattgaatattaacgtaatttatcaggaattcttctgcatgggagatttgtctcttcttccccatttattaacatatttaatcatttatttatatcagtatgaactcatggatgatgattttatacttcatactataatccactgctacattagattgttgttcaaattgttccaccttttgctacttagaatgagaaaacattataaattgaatgaaaataaaaacacctcaaaatgtgtgggatgcaactaaagcagtacttacaggaagatttgttgtattaaatacttgtactactgttgtccctctgtatttgcaaggaattggttccaggacctcccacagataccaaaatcctcagatgctcaagtcctttacacaaaatagcatagtatttgcatataatctaagcacaccctctctctcaaatactttaaatcatatctagattacttataatacctaatacaacataaatgccatgtaaatagttgttatatttttaaaatttgtaattttttgttgttgtattgttatctttgttcctaaaatatctttgatccatagttggttgaatttgtagatgcagaatctacagataaggagggccagttgtatttatgaaaaagaaatatatcaataatctaagtttccaccttaataaattaagaaaagataaaataaaatccaaagcaagaaggaaaaaggaaataataaagagcagaaatcaatgaaattgaaatcaatgagaaagtaagggaaactaaaagctagttcttggaaaatatcaatagaattgatacagtctctagccaaactgatcaagaaacacagaacaaagacacattttatgaaattgaaaaaaaagagaggtgatcagttaagataagacatcaaaaagttaatgagggaatattacaaacaactctagtcccataagttagacaatttacatgaatgggacaaattcactgaaaaatacaaactgccaaagctcattaaaaaaaagagagacacctaaatagtcctatatcaattaaataaattgaatattgttatgggctgaattgtggcccatatgtggccgtatttggagacagggtttataaagaggtgattaagttaaaatgaagtcattagaatagcccttaacgtaatataactgatatccttataagaagagattaagacacagatatacacagtgggaagaccatgtgaagacacagaggaaagacggccatctgcaagtcaaggagagaggcctcagaagaaatcaactttgctgacatcttgatgtttgactgctagcccacagaactgtaagatccattcttggatattttgttataaaagcacccccccaaaaaaaaaaaaaactaaaaactaaaaactaacacaaatatgtatttagaaacctcacaaattctgggtccagttggcctcactggtgaattttagcaaacatttaaggaagcaatactaccaattttatacaaacttttccagaatattgaagaggagaaaacacttcccaaataattttataagggaagcattactctgatactaaaaccggaaaaagatatcacaaaaaaagaaaattacagatgaatatctgtcatgaacataaacacaaaaaaagtcttcaggaaaatactagcaaatcaaatcgtaaaacataaaaacaatattacaccatcacaaagttgggcttatcccaggaatgcaaagcaggtgagatatttggaaatcaaccaaagtaactcatggtatatcaacaggcaaaaaaaagaaaaactatatgatgatctgaatagatgcagaaaaagcatttaacaaaagtaagagtccattcataataactccgggaaactaggataataggaaggctcccttaatctgataaatggcattcacaaaaatactacagcgaacattatactttatgatgaaaaacagaatgctttctccctaaaatggagaatctggaaaggatgtccactccctttcctcttattcaacattgaaccaaaagtcctagcgaatgcaataagttagtaagtcaaaaaaaaaaagaaagaaagaaagaaagaaaagaaatgaaaggcatatacattggaaaggtagaaaaataaaactgtgtttattcaccaacatgagtatctacttaaaaaaattccaaaaaatatatttaaaaggccctagaattaatgagcatttaggaaggttgaaggacacattggtaatatacaaaaatcaatcatatttctatctactatcaatgaacaatagaagttaaaatatttttcataagtctcatttacaatagcaccaaaacatgtgaaatattagatataaatctaacaaaacatatatacaatctatatgttaagactgcaaaacaaacaaacactgatgaaagaaatcaatgcagacctaaacagagtgaggaatgcttccgtcaggagaaacaacaacaaatccgttaaagtggaatttgagaacgccaccaggacattttgggttcctcatatgctactgaatcatcagggaaagggggattactacactgcctagtgtgctggattccaagtattaaggggaaactgggctgctgctttccaatggagtaacgaggaatacgtctgcaatgcaggtgatcctctagggtgtgtcaaggtgattaagtaaacagaaaactagaaccacccaatttaggcagaactactaatgacttagatcttgaggaatgaatgtgtgggtcaccctatcagacaaggaaccacaaccaaatgggatgtttgctgagctgaaagagaataccagacaggtgtaagacggcagtgatcaaaaccagatacaaccatgtgaccagctgcataaacagggataaaatattgtgaatttttctttcttttttgatatgcatattttatacatatatatatatcatatttttgttttcttttaaaaatattaaagggaatgtgaatcagttggaaaagaaagaatatcactcaagacaaaaaagagacacttttggagaaggggagagaatgttttcagttgtacacagattagttttatcactgtagatgcaagcataaggttgtccttatttggatattaagtaacatttaaaagggtgtatataggtgccaggctgatacagggtgaactgtgatagctttataatatgttgacatggctaggctggaccacttttcccagaattctgttctctgaatgtttccagctaaaacagggcacaagcgaggttctcatgtcagatctggaaggtgaacatggggcagcagctattctgtgctcagatgcactatggatgatctcctgactcccctcattctatatgtggaaggaagaacttaaaatcacaacagtgccaatcctacctgaatgaatataactggcatgtcattctatctaaatttcaaacaagtttacacaggaatgaacaaaataatttaaaatcaccgatgcagcaaaaacttgcccaaatagctacaaaaatgtattttttaaaaaattagagggaggattttcctttccagatatatttagaataagtagaatcaaaacagaataatataatatgtccacaggaacaaacaagtcagttagtgaaaaaaaatttagagaatacaaaaggatcaaacatttttggaaacttaatatgtgataaaagtatatataaattcatttgggaaatgtggtttacttagtgaatagtgctggtataactgtccagtcatatgaaagaaaatatagttttctatacccctataatatttagcaataaactgcagatagattcgtgatctaagcaaaataagtgaataaaaattctgaagaaaatttaggagaatatttgcatgtttttcctgtaaagaagacctttttaaacattttagaagttaagaatgttcatgaaagtctcccttcttaaggtatagaattgagggttacaatttatagcacatttgtcagacagacaacatgttaagatttccaacatgtgaagagttcctacaaattaataagaaaaacaatgaacaaagtttataaatatgcaaatccaagaagaagttaataaacatatattaagatacttgatcctagctgggcacagtggctcacgcctgtaatcccagcactttgggagaccaagacgggtagatcacaatgtcaggagttcgagaccagcctgaccaacatggggaaacctggactctattaaaaatacaaaaattagccgggcatggtggctaagcttttggaaaggaatctggtattgcccattaaaatataaaacgaacataaactttgacttaactatcttactttagggaatctaaccaaaatcaaagtaccagtacttaggaaatacgtgtaaatatatatattgcagaaaaagtcaactggagaatgggtgaatatattatggtatttccatacaatgaaatattagacaactattaatcctatgtcagaatatgtcttaacctatataataatatagtttaaattttaaaaactatggttgcagggtaattgtagagttgcagagcacacatcaatttttatttaaactttaaacagaaaatctgtttttatatctttgtgtattcttagataaactattatattggttgcctctgaaccaggattcaggatgatgggaggaaattattaactttttctctatatcattctatattgattttcactaaaatattagcatacattaactttataatttaattttttaaaattttggcttttaaaatattttattaaatgttaaataggtacaaaataataattaagtaaaatatctttaagaacaatacatacccaatttaaaacagaacattagcccctgatgctcctgtgtccccttcccagacctcattccttgtcctcctccctcagggaataatcactattctgaattgtactatcattccttttgtttgttttgtttaccctttatgctgttttgcatatttcacaaatttatatagattacattattttgttttaaatcttgacttttttgctaagactgcatctgggtttattcatcttcacattaaacaaaatacaatatctaattcatacatgctggtgttgacagatatctgagttgtttacagttgaagtctattaaaaacaagcctagtatggacattcttgcatatgtcttctggtagaaaaaggaaagagtttctctaagctaaataaccaggaaggaaattgctaggacatatggcatgtgcacactaaaaaaataccaaattattttccaaaatggtttccatcaagccacatactcaccaatatcaactattatcacatttttaaaaatggaaacaatctagtcagtgtaaattattatttcactatgatttaattttcacttccctgattcgaaattaggttggaccactttttcatattttctcttctgtgaaatgtttgttaatgtgttttgcccatttttctatttggttatcttttacttactaatatgcagtttcttatattttctaggcattaatcctttgtgagcatagacctcagtaacagaccctaggaggagcctaaccatagtcctaaactgaaactgaaaaggagggtactaagaaagaaaaaagcagtgtctatctacttttccctaggaactggccttactctaacagctaagaaatggtatttcctgtttgcaaagtaatgtgttcttatttttattttaaaaatatatttatattcaaaattccacttctgcctaaatatagaaagctagtatgagcatcactcctaccctaacaatatacataagttgaaaaaaaaacactaaatcaaaattttattgaacccattagagagctgaggttgcagggcaaccaagtagtctgcaatctaaggaaagacagactctcctaaggagtgacaggacatgaacactggctccctgtggcagttcaagggagaaagagataccaggcactatacaaatgggaaagaagtattcagacataaaatgtaatgcactgctgatagctggatgtgggccagtgtgacagtacagaacagcgtaaagccacagacacaaaaagaacttgcacacattcacagactcaagttcacagacctccaacaggtgctcataagaaagactgagagcagagcaggaaacgggaagaaccattccctcagaagggtaggcttggaggaggggagccactgtcatggtcgaaaatgcgtaaagccccacttagacctatttctcccagaacaaaagccttacactgcaggaggaggagcagcaatccctgctttgtataagtgtatacccactgcagttggaaacagagcaaacaaaatccatctattcctggagaaggtgcagaaaacagtcctaagcccaggatttaatgccattattattacaaaactcctaccactacactaagtgaaggggaggaaaccttctccactgtagacttgccaaaggtgtcaggcagagtctggatgccatgagaaggggtagtatcactaaccaagcctgtcactgaggaccagggacagaggacctgcccaaggctgagaatggaataggacaacaaagaatgacttggccctccctccccaggcacgcaagcaccagtctactgctggaagataggcaggagaaggaaagaaagcccttctaaagcacaggcacacaggggaggcctaaagctgaggacgaaacaggaagagaccaaaaataaaaactccttagcaccccagctgacaccctgcgcacaagctaaatcctaaggaattctaagccaatggttcaccataggtaatgagagcaacacaaaaccaaaacccagctcatgtcctaaatggcctaccagaggaataggcatgactatttctaggcataaattctatttactttagtctctttttttctacacccagtaccaacactcaatcagatatatagacacataatgaagctgcagcagctgcaacaacagaagccagtgtcaaaaagcaaagcaatcacagaaaaaaatatcagcaacaacccatctgtcagagttatccaccagggaattttaaataactatcattaacatgttaagctctatgaaaaatgcaaacaaaacgcattaacaacagagacggaatctgtaagaaggtgtcaaatggaaatgttgtacataaaaaacactgtgtgctttcaatgggttcattagtagacttgacacaaccaagaaaggaatcagtaaacttgaagaaaggttgacagaaattacctaactgaaatacaaagagtaagaagagtaggagaaaagaaaagtaaaaagcaacaaataatgttagtacagcttctttggaatacagtttgtctgttatacacttatgacccagcaatcccactcctagatatttaccttaaagtaatggaaacttatgtttacacaaagtttgtgaatatctgtagtacttttatccataattgccaaaatctggaaacaacccagtgtccttcaactggtgaatggaatactattcaataaaaaagaaattaaatactgataaatgcaatgacacagatgaatatcaaaagaattatgctaagtgaaagaagttggactcaaaaggctacatatttatgattccatttatacaataccttgaaaaagacaaaagtaaagagaatgaaaatagattactggttgctaggcaccggtggtagggtaaagggttaactataaaaaaatacaagagaaatttggggggagatagaaatgtactataccttgattgtgatggtaaaccttggtcaaacctcatagaactgtatgctaaaagggtgaattttactgtatgcctcagtttaattaagcatgttttaattaattaaaaattatgtctcgttttataaaagcatattcttataaactatttttgtaggagatctgcattttaataattgcataaggtgatattttcttaactggatttgacatttttcaaataaagtcattagagaagatgtttccaacatttgatgggatgttggttatggatgacctctaagatcctctccaactccaaggtttttgaggtgtgcatgtgatcccccaagtttacaaacacaaattttataaatatatatatatatatatacacatacacatatatgttaagtatatattcatagttctaattacatttatattatatatacatgtaaatacgtatacacaaaaagttctgaaatattcttcagtattataatttattatatatttgttattttctttttttccactataaacatgtgataatttgtaatccaaaaatgttattattttacttacaaagcatatattgtgcaacaaatttttaaaaaggaaataaggaagcaggttatttttcaaatctataaaatacctagctttaaaaaaatggattttactaaactgacatatttaatactttaaaatacttgaagaaaggacaggaattagccattgtgaatatggggtgtggagcatttttttaattgcatttttttatttttaaaagaaaatcctagaaaaccatattttcccatttttgaagttttccctagctctttctttcatttgtattagaaatatctttgtgcatatctctaaaatagagcctcaacttgctactacaaataggatgatgtcataccagaaagtagaggggagagagcctgtgatggccctgcagcctcctcatcctcactgctccacctgtctcttctgaaggggcctctggctgtccacatgctgggatcactgccactagaaaagaaatgtatatatttgcccatggtttcaaagaatatatacatttgagaaatactttctaatcatcttcattgattatttaattgacattcatttccatttcaattcagccacccactcccattgtcatcacctgaaactggcccacttgtgaaataattcccaaatcccaatatctgatcacaaactccatctcctcctactacttttaccttgcaaactagtcgcctcagatccatccacttatttaccttctcccctcctttacctagactgtgggagggaagtactcgggtcactgggctttctaatatcggcagagagccgtttggaaaataccagcatgtccctggttggtttcctgtaccactcttccatggcagcaaattccaagccaccatcttgttatagtccttattttaatactctctctgacttagtaaaaatgtaacttcttctagaaaatgcaagccagaaaatagaaattctttcaatttattatcttttaaaacatttacttagatgcatcaatgtctttcttattccttgctttctgcctgttcaaaattcctccttccgtgttcttaaccagattccttctgcctcctctaaggtatttttctataacttatttttttttaacatatcgtgaatttctccctatctacaaattctttcatatcataagaatacacaattttctgtatcttaaaaataggaaatgctttaaactctgtctagctactaattgttaacagatttttcaaatcctagcccatacccactttgtttcctttgcaacgtctccatactcaactgactcgctaatgctattaacttggctcttgttgcactttcatttgcaaccctacctagcaaaatcctcctaatttgacttctgcatctaaccttcaatgtttagagaaaattcttcctaaaatacaaacttaattacacctgcccaccaatatcaggataaatcaaggccccttatcagacacaaaagtttaggatattggccaggtggcctctgtctatttttccatcaccatctccactgatttcctacatgcactgtatgctttaaccttagcaaaataagtgcctttttcttttacttctgtaagaaaattcgggtttcttactcttttctccttctaatttttttcttggattactgtaaacatttaattaatctccactgactgccacttccagctatcctcaccttgccaccagcattcctccttctggatggataaatagatagttgcatgaataaaacaaaaagaccctccgtatgcatccttttgattttaacagactgaataaaatgtatactcagcttcacatatatggcattacttccctctccagcccacactgtattttgggctccacctctcatcttctgcagcttcctagcattccacctcacatacaccctacgactcttggcacctaatatttctccccattacccctaagatattttcacaactccttaccctcgctcaaacttctccctcttgcctgaaatgttcttctctttttcacctgctaggtttctatttaattaaatcctaaattcaaccaaaatatcttttcttcaaagaagcttgtgggaaacctccctcatgcatagtcaatcttctgtacccacaatctttggatttttactctaaaataatatttactatgttgtacatcaatttgtcttttatatgtctgtttccctaattaaactgtgaactaaagagcaaaaaatatatagtagtttgtatttgtgtacagtgcttagtgtatcacagaatctcaaaatgtctttggaattactattatttgtttaatgcacttctgaaaattgtacatataaatttcatacaatacgcatacaaaaacacataatataaagaatatacacattcttatacagtgctattccagtgagggtagctaatattactgataaatctctaagaaaatatggcttaacaaaatgtttcctcatttgatgtttttgcttataacacctaaatttgaacattttataagcatgaaaacttgtttctttgttttcctaatggaaatttactgttcttcaggtactttaaattttttaaatatatactaccagaaattcaccatactaataaacctgttgtttataccatataattttctttctgaaaacagattacatttctaataacatttagtgctgtaccgtgagcttcatgctacctcaagtacactgaccacttcaaaagctccaagcatatttgcaaaagctttgacgccatgtaactattgagaggatagagaaatcgaatccttcaagaatacttttcccttatgttaattaccatatttttgagatcataaacatatttctaagaaagctaaatcaagtttataaaaagctatatcttgaaaaattaaacatttcagggccattattcactgtctccatgcagagggctagctatgaatataagtagcataaacagaaaacccactaaataagcatattagttatacctttctgaaggctcttcaaaaacatcctcataatcattatgtgggaaattccgaagagaaagttttaccttctctgaattaactttattttcaaaaacctacagacataagaaaggaaacaaattatagcactggttttagaaaaatatggtttaaaacgtgatttctatagctacttaagaagagcaaaaagatctgcaataatggaattataaccacaatcacatagtataatgtctgctcctagaaaatcacttaattgtatatctccctattaaatatcttccaatctgtcaaaacagtgtagagtactatgtaaacagaagttatttatattgaattgctcaagtgatttttcaaaactaaatttttaaaaagcttcatttgagaaaaaatagatttattacttcagcccagaagagattttcttataagtgtttaccatgttttgtttactgtgaatataaaattcctgccactaaatttatctttactttagtacttgcaccatctaatctactaattctaagtatttctccacattccactgcccaattttgcaccgggcagtggacttcagtcttgataactcgcagtgccagtgccccagccaccacatacacgtttccttccttccttgtctaatactgtcttgccatacttggccttctattttctcaagaacatcttttgaatcagctgatcaaatctcattcacacacagaaataactttgggactattattgaaattaagtaatatgaattttttaatttaaattggaaataagtgatgtatttatatattaagtatcattatccactaatatgatatagctatccagcaaaaagattataaaatattctcaataaagacaatgtataccttttcttagatttactcctaaacaccttaagtggcacaattgtaaatgtaatgtcatagagcagaccttttatttgatacacactgctcaatccacaaaccacatgtttttacatctagtatttttgtgtacattccattctaaatactttaaacttccattatgatttcttctttgactaatgagtttgttagtgtttgcttggtgtatgtttaatttttactttaaaatcacaggaaaatgtccacctaagattccttctcattaaactatgtagctacaatacacgaaatgaaatgagcttcacagaattgaactagttttgaaatcagcactgattggcaaatccctaaaaattaatttcaggataattaaaattgaaatgtagaaagtgtggctccagtgggatggaggaaaagaagtgggacacatgctattacacaacatgatcccacttccctcttacgagacatgcttaaaagtcatttgagtacaattcatttacttagaaaaagtgatatctggaagtcctaacacaatttaaacctgagacatctttcagctcatggttcaaaatcaaatggattatatttattttttaaagaagcagactgttccagatggctgcaattcaaatttaaggctgactaacatatgtctgattgagtgaaaagtgattttgctaacaataccaagaactaacaaggagaaatataataaattatcaagatggcaggacttttggagattgctcacggaatcaaattaatatcaaattttttaaatgttagaaaatgttttctgaggagcctaagttagcttttctgtagtccatgcagcaaggatttatgaggacaaagtgaaaacagtaacacagataggagcctggtttctagtctgtgactcaagagttatatgatcatagacaaatcgcttcagctttcacctctaaaatgagtgctggcataaaaatgtctttaacaggccaggtgtagtggcttatgcctataatcccagcactttgggaggccaagacgggtggatcacctgaggccaggagctcaagaccagcctggccaacgtggtgaaaccccgtctctaccaaaaatccaaaaaataaattagcctgtctcaaaaaaaaaatttctttatgctccaaatctaaccaacttcaagtctatgagtctagacaatttctaggggacagcatcatatctgaaaggacataaaaatggctacagtatcaaattgtttcatgaaacataagaaaagcaagttctaataaaatcaggtaattttcccaacactataaaaaccatccaggaatgttctaagatccttttttatgaaaggaaactttaaagcatatcagaattcaccctagataggccaagctataacttagcaaaaaaacaaacaaacaagcaaaaaaaaacccaaagtaaaaatataaacaaaatcacaaaatgtgctcagttctagaagaagtcaaataagactataagactatataaaggatatacttgggccattctgtgaaggtgctccctttcaaatcgtctctgcttcaaagagaaaaccattctgatcagagaaaagaatcaagagtgagcggagagcccaacacggcactaacagccagagattcccagccaaagatgtgatggtagccttgatgtggccaacttaagtatagcagagaatggacaggagataataatcaagttacaacactgttcttaaaagctgcactcctgcccacctggggtggaggtggcaattgaacaggggaagtggtaggagcagtttttggtctatgtactgactttatctctattactcctgtaacttacaggaaatgaacacaaggccagcatcatcatcgcagttccaaagctccagttgactaggtaagagaaaaaaaaatgcaaagcacccaccagactaaaatgcatttccctttttttgtgctctaaccctagcactatctccacaaatggggtaatgtgttgaagtaagaggttttgtcacagacttttcacagccctctacttttccatagttcggagacacccaatcatgctgtctcaaacaatgaaaaagtccacaatcaatacatctaaaggtgcttcatacttcatgtgacatttattttgtatcttcattagtaacacaaaactagtgcctgtaaaatttccagagtagcattagaaaatgcaattcattagaaactttgcaaaaaattccactctttcaaatccccattttggtcactgtcaacactacagtgacaaaaaattaagaaatcattttggtgagaaccaaatagatacccatttcccagagagcacagtcagcaatttaggtattagccaaaattagtagagatccctctccttttagtcttacctttgatctaggtgtgttttcctgacttgatgaaggcaaagtctccctgaaattcaagtcttctgcttcagagtcatttccctcataatcgtttactgaacaaaggcggggggaaaaactgatcaaatagaaaacactatacagaaggaaaaatggagccttaatgagaaaaaacaagctacatgaggggcattttcatctacttttcctgttttccaaacaccccatctttatctcctatggtaatcatctctttctcccctgctttgaaaaaatcaacatagcaaagctgatccttcttctaggattatcctcagggagttgacttttgagcggttcccttgttcctcattgccatattattcaagaaagtactcttcaagtaaatcctagatatttacaacctgcagaacctatgcattgggatctacagaatacagtcttctgtgtttcagagtctatttcttgaataaagaatactgtgttacaaatgtcgcactgtaacttcttgtattatttataattcataagttagtaatatgttaaattatacagaaaattgttttcggctttgttgaataatgtaatatgaatcatcccaaggaaactctgggtttcttatatgattattcctaattactgtgttaattttactgcacagactctttcagataagaagccaagagaaaattttctctgatctcagtactgagcactcagagtactgtttctcataccatgggagccttaaatattatgatttagaaattctatggcatggcatattaccaaatcaataaaaatatagtaaacaagtactatggaaatgaaaaagtgtgttcctgaatgtgtgttaaaaaggaaatctaatagaaattatgaacctttataacacatgaattaattttataaattaaaacattaagaaatatcaatgaagggacaacatatcaaaactaatgtgaagtagctaaatgagtatttagatagagggaaaatgtataggtttaaatgtgtttacaaaaaaggcagaaaaaaaaagctgctataaatgagttttgtattcaatcatagaagccaaagaaaaactgaggaaacccagagaaactacaaaggagaaaatcataaagaaaaatataataacagaaaataagcctaaagaataatcagcaaaatccaataaactagttctttgaaaaaaaaaacttaaaaatacgcaaccctctttcactacaaatcaatggagagtaagtgcacaaataacattaaaaatgaaaaaggatcgcttctcggccttttggctaagatcaagtgtaaaaatgagaaagggcacagctacagatgcaactctcatttttaaaggtaataagcaaatattatgagaaactttagggaaatctgatgaaatggaaacttttataagagaattataagttatgcaaatttactccagaagatgtagaaagcctaaatagtgtaataaccatttaaaaagtcaaaccaataatcaaaaatatcactcccaagaggaaaaagcatctgggcccaaacaggtttccagatgggattttatcagactttcaatgaaaaaaatctctcatgcaaacggttctgaaaataggaaattccgcaaacctaggaaggagcttcaagtgctagaaaaaaaattaacaggaaaaaaaagtctatgagaattgtaaacaagcaactcatagaaggcgacttacaggccaataatatattcagaaaaagtccagcctcacctgacaaacaaaaaatgaaaagtaaaacaacctacaattgactttcatttatgcttatgagagatttactgtaataggacttaaccacaaccaaccagaaaataggacaaaatatataaaacaataattttcagaccttaaacaacagactgtgatcccagagagaagggggtgagccttctggttgctccagattatggcctccagaagtttgcaggctatagctcaggaaaggaatcaacgagtccagtgattcaatgagttgagaagaaaaagatcaaagttaggagaggctgaggcagccagaatttgtagggcagagtaccagggaggagggagctatacagaacaagagaagtctaagtagctgcaaagaaaccctctcatgtcctttgcagaatatggatatgcttatatgaaggaggacaatctctgacactcaggaaggaccaccggaaagtagcaagccacacaattcctaggaacagttcataggagccagaatgaggagaccctgtaatacagggggcgttgaggatagtgcacagaagagatacctcttagtactaaaactatccttggaacagaagctccttagggccacctataaaaaaggtgaagagcaagcctcagacaggatcaggttaaacttcaagtaacataactacaaggcagaaaaacccaacattctttaaagaaaaatcaaggccgggtgtggtggctcacgcctgtaatcccagcactttgggaggctgaagagggtggatcacgaggtcaggagttcgagatcagcctgacaaacatggtgaaaccccatctctactaaaaatacaaaaattagctgggcatggtggtgcgcacctgcaatcccagctactcaggaggctgaggcaggagaatcacttgaacccaggaggcagaaggttgcagtgagccaagattgcaccactgcactccagcctatgagacagagtgagactctgtctaagaaaaaaaaaaaaaaaagaaaagaaaaagaaaaaagaagaaaaaaagaaaagaaaaagaaaaaatccagcaccaaaatcatataattcacaatgtgtagtaaacaattaacaggtatgccaaggaatagaaaagtataacccacagccaaatcaatcaatcaatagaaatgtacttagaaatgacagatgataaaatttagaaaaaagaacttttaactattataaatttttaaaaggtgctcaaggaaataaagaaaaacatgatacaataaaaagagatataaatcatgtaaaaataagacctactgaaatttctagagacaatgtatgaactaaaataaattaacagcagataaggcagaaggaaaaaaaatcagtgtctgtcaacatacagcaagagtatatccaaaatgaagcgcacagtagcgaaaaaaagagactgaacagactcagcaaactgggacaacatcaagtgaactaaaattcctgtaactggaatgccaaaacaaatatgaagaaataatagctgaagtgttaccaaactagatgaaaactataaaccaacagaccaaagaaggtcaataaaatacaaatgtaatatatgagcttatagaaaaatcacattcatgtatgtcatattcaaattactgaaaagaaaaaatgccagagaaaacagacacattaaatatagaaaaacaaagataagaatgatggatttctcatcagaaatcatgcatgctagaagataatggtgagacattttaaagtattgaaagaacatagaattcttatagaatgtcaatatagaattctataccctgaaaatatatatttcaaaaaataagacttctgtagaccaataaaaactaagattatatccagcctgcactaaacaacaacaacaaaagttaaaggaagtttttcaggcacaaggaaaaggataaaatatgaaaatgtagaactatccaaaggaatgaagagtggcaaaactggaaaatacatgagcacataaaacatactctttcacatgttctaatttctttaaaagataactcaattataaggaaaaataataatctattgtagggtatacaacactcacaataaaattggtatcaataatagcatgaaaggcaaatgggaggaaatggaagtatcttatgttcctacaactatatgtgaaatggtaaagcagttcccgcttacccacagggaatgcctagttccaagacccccagtggatgccgaaaacttaggatagtacttcctgcactgaagtcttaaatccctcaaagtcatccatgagggttaaaatcagtttttcccaaactcccattaatgttgacattttgacctcctcccataaaccacaaatgttcttaatggcgtctagaatggggagttatttccaaaaggttttcaatttactttgcccagagccatcagaagaatcactatctatggcagctacagccttacaaaatgtttcttaaataatgagacatgaaactcaaaattactcattgatttctaggctatggaatagatactaaatcaggaactaactcagtaatttaaaaaaacctaccaatcagaaagagcccgggccagaaggattcacagtcaaattctaccagatgtataaacaagaggtggtaccaatcctactgaaactatttcaaataattaggaagagggactcctccctatctcattccataaggccagcatcgttctgataccaaaacctggcagaacacatggtctaatatccagaacttataatgaacttataaatgaacaagcaagaatcaaacaaccccgttaaaaaatgggcaaaggacatgaacagacacttttcaaaaggagacatacacatagccaagaagcatatgaaaaaatgctcaatatcactaatcatcagagaaatgcaaatgaaaaccacaatgagataccatcttacacaagccagaaaggctattattaaaaagtaaaaattaaaaaaaaaatgtttgtgaggttacagagaaaagggaacacttatacactgctgatgggaatttaagttcaaccactgtggaatgtggtttggagatttctcaatgaacataaaacagaactaccatttgattcagcaatcacatcactggctatatgaagggatataaattgttccgtcataaagacatatgcacatgtatgttcatcacagaacttttcacaatagcaaagacatggaatcaacctacatgcctgtcaacagtggaatggataaagaaaatgtggtgcaaaaacaccatggactattacacaaccataaaaagaatgaaatcatggctgggtgcggcggctcatgcctgtaatcccagcagtttgggaggccaaggcggatgaattacctgaggtcaggagtttgagaccagcctggccaacatgatgaaaccctgtctctactaaaaatacaaaaattagccgggcatggtggcacacgcctgtaatcccagctactcgggaggctgaggcagaagaattgcttgagcctgggagatggaggttgcagtgagccgagatcgtgccactgcactccacctggctgacagagcgagactctgtctcaaacaaaaacaacaacaacaacaataaaaaaaaaaaacaaaaaacagaatgaaatcatgtcctttgctgcaacatggatgtagctggaggccattatcttaagtgaatcactacctgggtgatgagatcatttgttcaccaaaccacagcaacaagcaatttgcccatgtaacaaaccttcctatgtacccccaagcctaaaataaaagttggaaagaactagtctacaaaaaagtttgggtagctttccatgtttttgcatattctagcttaactgatttatcattaaaattagctttttcataaaagtttgcaactgttaaaggatagtttccagaaaaagaaaatcacagctctcatacagacatataaatgcacatgttactttattatattcattaatcagtgagggaatcaggcagatgttatttttaaatttttttttaaaaaacccataatactgtgtgttagtctgttagcatcactacgtaggaatgtctaaggctgggtaatttataaagaaaagaggtttgttctggctcgtggttctgcaggctgtacaggaagcatggtgctggtatctgcttctagtatctaacctcaggaggcttatagtcatggcaaaaagtgaatgaggagccagcaaatcacatggtgagagacaaagcaagagagaaggggaggttccagactcctttgaacaatcagatctcacatgaactgagagagcactcactcatcaccagggggataacaccaagccattcacgaaggatctgcccctatgatccaacatctcccaccaggttggggattacctttcaacatgattagaagagataaacatccaaactataccatacaggaagtccttgccagagcaattaggcaagagaaacaaacaaaaggcatccagattgaaaagaaggaacaattaggcaacagaaacaaataaaaggtagccaaattgaaaaggaggaagtcaaatttgtccctgtttagagatgacatgctcttacaaatgcaaaaacctgaagaatccaccaaaaaactcttagaactgataaacaaattaagtaaagttgcaggatacaaaatcaacatgcaaaaatcagtagcatttctataaaacaataacaaactacctgaaaaagaaatcaagtaagcaatctcatttacaataactacaaaaaataatacctaggaataaatttaaccagagattaaagatctctagaataagaactataaaaaattgatgaaataaattgaggaagacacaaaccaatggaaagacatctcatgttcatggaataaaagaataaatatttttaaaatgacaatataaccaaagaatctgagagctcaatgcaattcctatcaaaataccaatgacattcttcagagaaattttaaaatcataaaattcatatggaagtacaaaaaatactccaaatagccaaagcaattctgagccaagaaaaacaaaaacaaaataaaaacaaacaaacaacaacaacaaaaaaacaagaacaaagcttggggtattacactacctgacttcaaaatacactacaaatctatagtaaccacaaaatcatgatactggtataaaaacagacacatataccagtggaatagaatagagaacccagaaataattccatatgtttatagccaactcttttatgacaaggcacaaagaacatatattggggacaagaaagtctcttctataaatggtcctggaaaaaactggatattcctatgcagaataaacttagactcctatccctcatcttacacataatctgacttacagatggaatccaggctcacaaaagcagatagcagaatggtggtttccaggggatagaggaaggaggaaatggggagttgttggtcagatggtatcaagtaacagttacacaagatgaatacgttctgaagatctgatgtatagcaaaatacatacaatactgtattgtaatgatatttgctaagagggtagatcttatgtttgtaatacacacatacacacaaagaaagaaaatggtaactgtgaggtggtggatatgttagcttaattgtggtaatcatttcacagtatatagacaaatcaaaacatcaagttgcacaccttatgtatacacaatttttgtcaattatacccgataaggattggaaaaacacttctagggagagagcaataataatgacaaggagggcggatagaagagggaatagaagctgggctgaaggtggaaggaatgagaaaaggcataaaagacatactgaaaaatgatggcaagctactaatgttttaagcaagacaatggcaatatgggtcggctgggagacagctgacatttaactaaaacactgcattagtagatgtatcaaaaaccttagaaatgtatatgccctgagttcacagctaacaaaattatggaaacaaacagctttgtggcagattacaggttgtttttattgtcttgttgttttctttgtgttttggtgcttttttgtacttcccaaattcttcacaataaacctatattacatttataatcaggaaaaaaaaatgccatttgaaaagggtaaagtaaaacactagagtttaattgttgttactctaagcgtgatggcttattagaaatgcagagtcttgccccccaccccaccccaccaagacccagaggatcagaatatgcaggataataatccacaggtggtccctatgcaaatctacagtctgagaggcactcctgtagctcctcctgatcccatacccacaaaagtagatgatgcacctaccaggctctgctctaaagtccctaggtgaagacatgttgttcccatcccctaaatgagactggtaaaaggcttcttcagaaaaggagccttagtgtcctgtgagtcaggccaaaggtctagttagtatcctgggggccagcaaacaatttttgttcacctggtaaaacacacaaagccaaagatttttctgttacacaactggagctatcacagctttgacatattattactcatcaattcaaaatatttaaaactgcaattttaattaaagacaaaataaatttcatttgaaattttatcaaataatttcaggatattccttgagaactggagatacgcttatttattcaaataccagagcttaaatatgctataccttgcattccacaaataaatatgtgaatggcccctccactccaatgatgtatctctttatataaacacacacacacacacacacacacacaaattcaatcaatgtcactcaatggaaactcagttatttaaatgccacacctaagctaaattaggtgctgagaattcagtactgaataaataagaattaattacagagaccgtcttcaaggagttcttgttcattcaatctataaaaagttctcacacagaataaatcttttttcttttctaattcttgccataaagggcctgtaaggccatgttacattgctcccattggttaaaaccaagaatacttttatctggagacctttccattaactacctgcaaataaaatggtattactataatctgaatctaaagttaatgtgtgaaacagatttattttaaaaactttgagatataggtgttaaaaaattatttaagactaggtgtagtggctcatgcctacaatcctagcactttgggaggccaaggcaggaggatcgcttgagctcaggagtttgagaccagctggggcaattgggtgaaaccctgtctctacaaaaattagacgggtgtggtggcacacacctgtggtcccagctacttgaaaagctgaggtaggagaatggcttgagcctgggaggaggatacagtgagccaagatcatgccactgcagtctagcctgggcaacagagccagaccctgtggcagaaaaaataaaattaaattaaattaaaatgtgaaagtaaggcaaaagataagtggaatgtcacttcaatgtcataaaataatgacaggccatcccaaagattacttatgtggggaaattgtactttattcagttcattgtttactactgattaaaagtcctagacttaatgcaattacaacgtaacctatagatttttgtccagcagtgatacaaataatttctgtctgataaggtaacactaaagattataatttatttctgtctggcattaaccaggttttcttaatctaatctagcattcttactctaacattggttcaaaacgccagtgaaaaacctagatcctcaaactgttctttgaactacctttgccatcttcctggtttcttcactaattaatacattgagtaaaatgtttaacctggtttcatttcaaatttgtgagtcacatttataatttttaaaaaactctgctttgacaaggggaagaatatcttttttaaataggaggagggctaggcacagtggctcacacccgtaatcccagcactttgggaggccgaggtgggaagatcacttgagctcaagagttcgaggccagcctgagcaacccagtgagacctcatctctaccaaaaattaaaaaaaagaaaaagatagccaggtgtggtggcactcacctgtagtcccagctacttgggcggctaaggcaggaggatcacttgagcccgcaagatggaggctgcaataagctatgattgtgccactgtactccagcctatgcaacagagcaagactctgtctcaattaaaaacaaaaacaaaaggatggcagtgttcttgtgactggcagtgaggtaacagatttcagtaaggagccttccctggaagcagacatgagatcttaaggacctcagaattaactaagaacctctaagaatgacacctaagcttctgcctaccaactatgttattgaaaagatacaaaatagtacaattttaattaaagacaaaataaattttgtttcgaattttatcaagtaatttcaagacactccttgataactggagacactcttactaattcaaatactagggtttaaacatgctataccttgcattccacaaataaatatgtgaatggtcctttaccccaatgacttatcctctttatataaatacacacacatattattaagacctctccagtgcacagatgaatagactaaaattcatatcaaaccataccaatagtcagttgttcaaaccttccatcagaacagctttgatcagaaatgcatgcctaatcctagtattttaataaacaacagtgcagtgagtcacagataaccctacagaagcacaagaattaaactggataaatttccctttcctggcatgttttctagtatatcttaaaatagacaaaacaaagcaatattaaaatcattaacatttaattcaattttgagttgcagctactgtagtaaaccagtaataagatcatacaagtcaacatcaacacatgtgtactgaaattttaggtagcctagaaaagtaaactatatgataaaaacaaaatcttcatttgcagaagaaaacctttcagaaaatatagtgcaagcttttaccatatttcccacctcccctcaagcttggctaagtaagcccctgcaagtgcttcccctataagctccatgttttataatgatttctggactcatctcctcgggttggaccataagcatcttgaggacagaaactgtaacattttcacttttcaatctccagccactagactaacacaatggagacatggcaagaaatgtttgagggactaattagttaaattccataaagaatgtgtatgtatcaccaggtaactaatctgcatgtccacatcaagaactctgagaagtcacagaggtaccacttgagtgataggcactcggtcccttagggaaagattgtgaaagatattgagggaccagtggtcaggttcgtaagataaaggtttccctccaactcctggggaaggtgcaatagtatagaaaatagagaattagccctgataaaagagaaatccttaaaaaagtattacttattctgtgatagagcactgaggaaagaggaacaaaagctccaatatgaaacaaagtgatcccatctaatcataaataaaagaaaaactacaagtgtttggtttgctcaggaaacaaaagcaaaacacctttcctcaggtggcagggtgacataattggagagtcactgaatactgtacatattctcaaattctcagctgggacactattttcagtctatctcaaactctctcaaaactgaagcaggtgctaacaaagactatttcttcacagtggactttgggttgggtgcaagatgccaaaatagacaatgtaaaatgacatgctcagcaccttgggcctctggcaattcttagcaccagggctacttctaattcttgtgaaagttctatcatacactactccctgagacctatactagcctgaagagaagggaatgaaagaagtctcaaatgttcaatagtgacttactcttgccctacctgtaggcaccccagggatatgagttccttcctctgaaatctgtatttcctgtgactaaattctcagtacaagcttcttagactactagtaattatttggcatgttttatgccttttaataatggctcttagttttctataaggaatggtggtattgctttttctgattataaacataaccattaagaaatgtcattccgtggtttcttaatcaatcattccctgtagtgtgtgagtataggactgggggctcagagggaagcagggagaagtgaagtgctaaagtgctacctccagagccactgacagttctgcccaatgcaatcaggcaaaacaagaaaaataaaataaaaggattcatattgggaaggaagaaggaaaaccatctttacttgcaaggttaaaagctttatacataattacacctcaataaagttgacttttaaaaagccacaaaaagataatgtacttaaattaaaataaaatacagaaactctaggataaagataatatcaagttattaatgcaagtttaaacattaaaaaatagttgctacccactcatcacagacatgagcagcaagctcattaaagattactgtgagcattcattggaataatggaagactcaaggttccaaaggcactgagaccctatatcaacaatgcttcacccttgaaacccagggactgatgatgatacagttgccatgagctacattctgagtaaatactttatcaattattagaacggttcaagtaaaagtaatgaatgacttaagacatctttctgaaatgactcttttatctggatgcctctgctattagggtgcaaggcaaacaaccttctactgtttgtttcattcatgatataaattgctttggcatattccctccaacctcctgaacctcaggtcgatctgtttgtccatttgtctgtttacacttcttttcttccctccttcctacgttcctctccctctcttgtggaagtgtatcagtaattataagagggtgctttatttcagaagacacaattcctgtacctccaatcactgttaccaagcaaaagagttcactgttcaatgtgttagaagccaatactatggcactgggtttttgagaaaagaaagacttttttctaggtcaaccaacaaggagacaggagtctagctcaaatctgtcttcctgtactgtttttaaggcagtatttttattagaaaatgtgtagggagtgaatttggggatagtaggagattggtagaaggaaaggggggtctgaaaaggctttgggcatttgcagtatctcttcatgctatctcatgggtcacatatgtaaattcagggggagttagtacgaaacatgcagtggaaatttgggctgtggcgtcagcaagctcattctgtgtagactctagtttgctgtattggttccaactgatttcagccagttttgttatcttaaaagcagagagaatttcagtgtttcagaaagttgtttttgttttttatttttatgaaccaatcctataaattcaagaatttctctttgccactggttaactctttggggcacagtttcattagtagaccttggcctccatactccaaagaactacttatctactgggtgcagctgaaccatttccataactgagatcatgtaagtcaggaatgtatacacattacacatgtgtgcagacaaaagttcatgacttcacctaccaggtccaagacgagtctccttaggaatgcctgcatacaagcctggcccttggctggtgtctgggaacttggctggtaaaatcattgcctacactaatataaattttttctaaatgagaaaagtagctcacttctcctaaaacatctgttttccttctaggtatctggaatttcagtgactgctatcagtcacactgacagtctgtgctcatgactaacccctgataaaaaccctaaactcttaagctcagacgagcttccctgatagacaacacttcacacaagtttccataccttgttattcagaaaattaagtgcatcctatgtgactccacaaggagaatattctggggagtttgtatctgatatcccttgttgattttgctttctaccttttcagtctaccatatcttagccatgaatgtgactacctgctgaaccccatgaatccttctatccaatcgttgaacctgggagagctctgacaaaggctagcatgggaaaatacgttgtcttcctcattaacagacccttcttagttatatctcactttctaagttcctgccttccacttcctaggagagaaaaaactacacagcattacctgaacatcatcccagggtaatcacagagcagccatctccgcaaaagaaggaaaaatgaactgtgtaatgttgcaatatttttaactgcaaataattttgcatacaaggcttacctacaattgaccatttttgcactaaatgcttttttaaagtaacaagctaatatcttcttaatataaaaatatacatgtccaacaaaatttaacttgttctgctatcatgaaaagaggaattccagacaaatgtctcataatgtgcagtcagtgggcttatataaataaggactaaaattacaagctcaataaaagatcatcaaaccagggaaaactccaagtaaaattataatacacagttgtccctcccacctgagactcacctgagactcatactttccttccaacatgcctgttctgcctattccctcaagactcagacttcaaatgagttccctttaagtagataagaacagtttcgcaacggattccagaaaaaccaatatgccacctaaaggacaaggaaggcatctacactaagaaaatgaaaagaagtcagagagagaacttcctgacttactcagattatatacccatgggtccacatatgcctaaaggccaaccttgtccttaatctttagtcactcaatctataaaataaaagatttagaaaagggctatgggcaatatggatcttttgcaggtacaaaattttttaagtccataaactttctctttaaaacactgaagaccattagtgatggttataatattcttgtctgaactgagagctatagtcaggctccttttagaagccctgccatgaacagagaaaaaagaaaaggcatgttcctactcctctatcctctgtagacatcttctccgtgataagttaataatgagaagagaaaaccaaccttctagctttctcatcatttaatggtttgaaccctgagtttctgcagcctggaaaaaaaaaaaaaaaagaggaagcagcagcagcagcagcagcaagttctcctcatctgaaattcttccctctcctagctcaccttccccaccttctcactcctttgtggtcctcacagtcagatatgaggtaataggtggaaaatacttccctgtgataaggcagtgatgcctgagccacccacttctggtaagaaagctgttcctaaagaatagcaaatggtactcatgttttgggggactctatgctacttagaagcgagtggctaaagttgcacggtgactaattcaagaacaaacagaagaaaaggacaaacagaaaaataaacagaaagaggcatgcccttagcctcaatcaggtagttctaagaaagtgattaggatggttcggagaccaccagccccataccttatccagtcaccaaacaacccaggctggggtgtggttgcctggcaaccacaccttccatgtaccgagtatgtcacaaatatgtctttccggtgtgtgatctcttgactgtgaaaagtaaaacgctaaatcaattcagcaggctttgagtgtctacaatgtgctagtcactgtatcagagatgtggatccagggatgatgcaataacttctgcctccaaggagctcatagtttagtggacatctggcaaagtactcactgattcttgacaattcatataatcatatcaatagatgcaaaaaagcatttgacaaaatccaaattccatccttgatttaaaaaaaaaaaattcttagaaaactaggactagaggcaaactttctcaacttgataaaaaatatctacaaaaaaaatctacagggagaatctagaggctttcccctaagataggtaacaaggcaaggatgttctcttttaccactcctattcaacatcttatacaacttctgactaattcagtaagaaaaggcatacagttgaaaaggaaaaaataaaactgccttgcttctcagatgacataaatgtctatataaaatatctcaaagaataaacaaaaacaattagccacttaatctataaaataaaagatttagaaaagggctatgggcaatatggatcttttgcaggtacaaaattttttaagtccataaactttctccttcaaacaccgaagacctggaacttagctgggcgtggtggctcacacctgtaatcccagcaccttgggaggctgaggcatgcggatcacttgaggtcaggagtttgagaccagcctgaccaagatggtgaagtgccatctctactaaaaatacaaaaaattagccaggcatggtgccgtgcacctgtaatctcagctactcgagaggctgaggcaggagattctcttgaacccgggaggcagtggttgcagtgacctgagatcgcgccactgcactccagcctgggcaacagagcgagactccatctcgaaataaatcaataaataaaaactcctggaacttaataagcaattacagcaaggttgcagaatacaaagttaatatgcaaaagtcaattccttttctataaaccagcaattaacaattggaattggaaatataaaacacagtatcatttacattagctgctccccaaaactgaaatatacaggtataaatataacaaaatatatacaggatctatatgagaaactctaccaaactttgacaaaggaaagcaaatatctaaacaaatggagagatatttcatgttcatgtatagaaacactcaatatttttaagacctcaattcttcccaatatggtttataaagccaatgtaattccaacaaaaataccagcaaattgtttcatgggtatcaacaaattcattctgaagtctatatgaaaacgcagaaaacccaaaataatcaacaaaatactaaagaagaacaaagttggaagacagataatacaagatttcaagacaagaccacaaggtactgttgaaagaatagacaaatagatcaatggaacagaatacagtatccatataaatatatccacacaaatgtagtcaactgatctttagtaaagaagcaaagaaaattcagtgaagaaagaatattctttttcaaaaaatgataatggaacagaccttacacctttcacaaaaaaataactcaaaatgaatcacagacctaaatgtaaaacacaaaaactctcaaacttctagaagataactgtattggtgcccaagagctgctataacatggtaccacaaactaggtggcttaaaagaagggaaaacaaatctggaaattagaagccttaaatcaaggtgtcagcagggctgcactctatctgaaggctctaggggagtatacttccttgtctcttcctgtcttttggtggttgccagaaatccctggacagcacgattcaactgtctcacacaatttaaaccacaacagtcttctctccaatcccccaaaagtcatatccttactgtatgcaaaacacattcaccccatttcaacatctccaggacccttgacccattccagcatcaactctaagtcaaaattgcctctaaatatcaactgtaatgtcccaaatctcatctcctaaatcatctaaatcaagtatgtgtgagatcctgggtatggtccagcctggggcaaagtttctctcctatggacactgaaatccacaaaacaagttatctgcttccaaaatacaacaggcataggacagacagtcaccttccaaaagggagaaactggaaggaaaaagtgggtcacaggtctcaaacaagtccaaaacatggcagggaaattttcattaggtttccagggcctgagagggctgtctggatccatgagtcacacaggtaatcttttcagtgaatggttgttcagccacacccttggtcctgtttcgggagtatgtttcctggattggctgagaactttcaaacccatcaagtgctggttcctttgcttaacaattccttcctcaagttatctctttccttttgcatttcactataagcagcaaggaaaaaccatggccccatctttcacgctttacttagaaatctcctcagctcactgcctacaagttctgctttccacccacaggtaaaacacagttcacccaaatttctgccactctgtaataaggatcacttttcctccagtgtctgataatatattcaccacttcctttctaaggcctcacaagaagcacctttaaagttcacatttctagtaacattctgttcatgacaacatatgtattctctaagatgcaaagaatctatgatagatgctttttctaaaattcccctctctactgagccttcaccagaatcacctttaatatctgtatttctacaaatagtcttttcaaagcagtctaggctttttatgttatgcacctaaaaattattccagtctatacacaattccaaagccacttacatgttttttaggtagttattccaacagaaaaagatttccgggtatcaaaatatgtattcatttcctatggctgccataacaaagtgccacaaattggatggcttaaaaatgcagaaatgtattctctcacagttctgggggcagaagtctgagggtggcagcaaggccatgccctctgttaggccccagggaaggatgtttaattgtctcttcctaacttttggtggtttcagtaatccttgatgttccctggttatagacatcccactccaatttcagcctctgctgttacatgaatttctccctctgtgtccaaatttcccttgttttacagggacaccagtcattgcattaggacctcagcttaacttgtttaacatttgcaaagatcctatttctaagtaaggttggactcacaggtatctggggttaggacttcaaaatattctcttggggtataaaattcaaccacacaacaataataaaagagaaaatctatgtgaccttggttttggcaatgagattttaaatacaacaccaaaaggataatccaggaaacaaagttgataagctggactttattaaaattaaaaacttcttttctgcaaaatacactgttaagagactacaaagacaagctacagaccaggagaaaatgtttgagaaagcacatatctgacagaaaatttctaataaaaaataaacaaagaactcttaaagctcaacaatgagaaaacaaacaacctcatttaaaaattggcaaaataggcatgccactgcaaattccgtgaaacaggagaaaaactgtgagttcccaaagtgtaagagggagaaaaccgacctccaaacacacatccctgctgggaatctgaaaatccagatcacaggagaagaatttaaccttacctagagatggaagggatttagagagtcacacaaaatatgaaagtagaagtagcagcaggaagtgccttgtatgcactcccagtctccagctcgagcatagggacgccatccctgactatatctcactggggcccttgtggaagacaaccagcagaactgcggaagtgttgtggggtgaagaaagctcccagatgaaattggtagtggtttcgactgggcacacattttctggagtggagtccgaggaaggagcaggagctgctgcagatacaagcaagtacaggagtacaagaactgccaccaacagagcaggggcaaggtctgggcggggcattgcaggatatgcgggcttgccaactgcatgggagttgagtcaggcctcttgctactggctatccctgacttccctggcaaactatataatacagtagaggcggccaagatcccctatggaacataaccccattggccggagaaccaacccccagcccccacagtggcctcagcaagccccgcccaaggagcttgcctaaccctgctgcctaaccagacctgcctaaccctgctgccacctgacggcatttccctacctgccctggtagcctaacacaaaacatagaaactctggggagcttcatcccctgaaccctgcccccagcaccctctgctctggagggttgtctttaattgtctatggagcatatatatatatactctttccctatggtatataagccctgagtctggggagtaatggtgtgaacatctacctgtcttacacgaacacatttctgcccaagaacacatttctgtccataagtttcccctaaaaatcaccctctgccaataaactagatatgcctgcctcattctttgatttcttggctccttctgtatttggaggttattttgcatatatggccctttcaaggaatatctatctatataaagataaaacaataagctatcaagctataataagatatggagaaagcttaaatcaatgtttctaaagaaaagaagccaatttgaaaggctgcatactatataattccaactatatgacactaggaaaagcaaaacttttgagacagcaaaaagatcagtggtaagcaggggttcaggggttgagctagaataatgaacagaagaagcacagaagacttttagggcaatgaaactattttatatgatactataattgtggatacatgacattatacatttgtcaaaacccatagaaatgtacaatataactagtgaaccttaatgtaaactacagacttcagttaatactaatctatagatattggcttattaactatagcaaatgtaccaaacaaacacaacatattaataacagggaaaaccatggggctgagggggtatagggtaactttctgtactatctactcaattttttaataaatctaaaactgttctaaaagtagtctgtaaaataagatttttaagagcaaacagaacaagaattttaaaagataattgtctgaagcacaaataatgacaattatatggtgcactttataagatatgtagatgtaaaatgtatggcaatcataacacaaagtatgggtgggaaataatggaagcacactgttgtaaggtatatatattatactatatgtgaaatgatatattatttgaaggtagactgtgacaaacttatacagcctagagtaaccactaagaaaagaataaaaagaaggagaagaagcatggaggagaaaaagcagaagcaacataagggcagagtggagataaaatggagtaaaaaattgagtcattaaagaaagcctcatttaagccaaaagggtatgggaaaagaagggactagattaaagaacaggtaaggcaagtgcaaacctggcaagatgatagattaagatctaatcatatcaataattatattaaatgtaaatggtctggccatccaaattaaaagtcagggattgtctgactggattaaaaaagtgagatccaattatatactgtctacaaggaacccaccgtacatataaagacattgataaactaaaaaaatggaaaaaagataacccatgtaaacactaatcaaaagaaggtagaatggccatattaacatcgacaacatagactttaaaaaatgataaacatttccagaaatgaaaaggggcattacataatacataggaattctaaatgtgtgtgtatccaacaacatagcttccaaagtgataaaatgaaaactgaaatgaaaaaaacagaaaaatctacaacaatgttggagacaagtaggcagataataaggacacagaaaacctgaataacattatgaagcaatttggcctaacttttatagggcatcccagccaacaacaaaataagtattaaagtggacacggaacattcacaaggatagtccatattctgggcctaaaaacaaaccataaaacattaaactgaaatacaaaatatgtttttaaaaatggaattaaaatagaaatcaacagaaataaatctttaaaattctcaaatatttggaaattaaacaatatatttctaaataactcccaattcaaagaagtgacaaaggaaattatacaatattctgaattgaatgaaggtaaaaatacaacatcaaaattagtggatgcagctaaaacagtgctgatagagaaatttatagcattaaatatttatattgggaaataatagaggccttaaatgagtaatctaagttcttaccttaagaaattaaaaaagaaattaaatccaaggcaagcaaaaagagggaaataataaagaggaaaaaaaatcaatgaaatggaaaataaaaaaataacagagaaaaatcaatgaaacccaaaacaggtccatgaaaagattttaaaaaaaattgctaacctctagaccctcaatgtccagtagaactttgtataatgatgaaaacattctatatagcagcaccctccaatgtggaagccacttgggactactgatcacttaaaatgtggccagtgtgactgaggaactcaatttttaatgtaattttattgaaattaatttacatttaaatagacacatgtgactagggataactattgaacagtgcagctctagaattgactactgaaagaaaggaaggggtgggaaggaaagaggaagaggaagagataaaggagggagagaaagagggaggcagagaagatgagatacacaaataaccaaaatcggaaatgaaatgaaaaagaggacttcactacagatcctaatgttagtgccattaaaaggataataagaaagtattacaaacaactgtatgccaaagttgataacatagatgaaaaaaactaattccttgaaagacacaaagtactaaagttcactcaaaaagaactgagtagcatatacaatctgaatagccatatatagttttaaaaacttgagtccatggtataaaactaacacaaggaaactctaggcccagatacctccctgttgacctctaccaaacctttaaggacgaataacaatcctatacaaaatgttccagaaaatagaaaagagaacactccaaactaatttatgagaccaccattaaccttgataccaaaatcaagaatattacagaccaatatctttatacaccaatatccctcatgaatgtatatgcaaaaaaaaccttaacaaaatattatcaagtagaatagatttatttctccatttatttggttttctctcttcaatgttttagagtttttagtattcaaatattacagaacatcattagatttatccctcagtttttcatgtttttgataccattgtaaactgtatttctaagttttaatttccaattgttcattgccagtgctaaatacaattgatttttgtatattggcctcacatcctgtgtctttgccaaagtcatgttatttctagttgcttttttgtagattcctcgggctcctacataaacaatcatgttgtctgcaaataaagacaattttatttcttccttttttatctgtgtacatttatatcttttccttcctttatttcactgactaggacctccctataacgaacagaaattgtgaatggaacatccaatgtgatgctggtataagaatagacatatacctcagcaggaaagaacagagagattagaaataattcacacatagcaacaattgatttaggaggggaaaggtgccaagataatataatggggataggatagtgctttcaacaagtgtgtgggaaaatgagacatccacatacagaattatgaacttcaccccatactcatattatgtacaaaaatccactcaaaatagatgacagacctaaatgcaaactctaaacctataaaacttctagcttaaagcttaggggaaagcttttgtgacactggattacacaaagatttcttaagacactaagcacaaaccacaaaagaaataattgataacttgactttgaaaaaatcaaaagcttctgctcttcagaagacagcattaagaaaatgcaaagtcaagtcccagtctgggagaagatatttgcaaaacacacatctgaggaaggacctatatcctaaatatatagacccttataactcaaaaagaggacgacccaattttaaatagtcaaaagatgtgaacagatacttcaccaaagaagaaacatagatggcaaataaatatatgaaaacatgattaagacaactggtcaacataaaaatgcaaaggaaaaccatacgaaatactgctacatacctactagaaatgctaaaatcaagcacacacacacagtccaatacaaagtgattctggtgaggatgtggagcaaatggaatctcatgcattgctgctgggatctctactcatcatcttgctttatttttcccaaaaccactttttattaccttaaagtttgcttacccatgtaagtccatatatatcttctcacatgtttattgtctatcttccccaatataagtactatgaggctggcaacttggtctgtcctgtcatcactgtgtcattctggcaccaagaacagtgtctggcaatctttacatatttattaaaagtgaggaaggggtggaaagaaaagacactaagacatctataagtgaatatatgaaggcaaggaacccagtcacagccatctacagaggagcgttaagagaaaattaatttagaccaccaggaagctgcatgttgtaatgcatgattcccaatttcagctgcacattagaattagctggagagctttgcaaaatcccaattccaggccacaccagaccaacaaaatctgaatctctgagaatggaacaccagcactggtcatttttttttttttttttttttttttagacggagtcttgctctgttgccacgctggagtgcagtggtgccatcttggctcactacaacccccacctcccagattccagtgattctcctgcctcagcctcccaagtaactggaactacaggtgcatgccaccacgcccagctaatttttgtatttttagtagaaatggggcttcaccatgctggccaggatggtcttgatctcttgacttcgtgatccgcccgcctcagcctcccaaagtgctgggattacaggcgtaagccaccacacccagccaagcactggtaattttaaagttcccaggtgatcccagtgtgcactcaaagttgagaatcactgaaaaaatggaacctagaccttggaaatgtacacaactgagtgtgcaagctacttaacctcccttagcctcaaaattctcatctacaacatgggaaatatatgtacctcccagagttgctgaaatattgagattctatataaggctctcaggaaatgtaaattctcatccccaagggaaacttgatcaaatcttcatagcttagggtaagaaatgctaattctaccagcaattcacatttttcattgttagctgattattttattgaacatttacattgaggaaattcagaaatgctcatttttccactttcctggtggtaagatgctgcctgaagctatgtttaaattttcaagagtaaataaactatggcgggaaatctagctgactatgccagtgaatctcaaacctagctgtacattagaatcatctcagaaatttttttaaagaaacacacgtacgtccagaactcaccaggccaaattaaatcagaatccctggggtggctccagaatatcagtatttttttaaaaagctgatagaaaggtaattgtaaaacacagtcagggcttaaaagcactgatttgtactaacgatatgccatgctaactgcacatcacagtcacttggggagctcttaaaaaagttgattgattccagaaccctaccgagacttactgattcagaatctgtggaagtggagcctgtcattgtgcaaatcttcataaaactccccactggtgattctgatgcaaactcactgagaaccactactttgtatcatacatttactctacgtgttgtatatcagaaagatcatttaaaactttcagtggtctcaaatgccaagcctgccagttacttttaatcagtaactgacacaacacatcacagtaactccaatgactttacagatcttttcagaacacttttatgtccagcccactgacccacatcacctaccctatgctgtgccaaatactggctatgtagtccgttggtatttctaaccaaattcctctaaatgggctgctgatctgggaaaagcaacatggaatcacattactccccaagccttattcccctttgctaagtggtatgtaatgccaggattaatgaaatgaactctattggtcaaatgagtctgaatgaaatctgagttgttgtctgctcctggaagcaaactgttatctatttgtttccctcagagagataaactcagaggaaacaggagtgatccctgaggtgggaataatatagtgggctgcaattttaaaactctgcttagacaataacaggacacttggaatcttattttgatagatcaaaccaatcagtatatacagcaccatggtggtactaccaggcaggtgataatagtagcatttaaacaaccaggcactatattaggcatattaaatatattaactcatgtgattctcaactgcgatgataatagccctatcaggcaggtactattattatttccattttgtcaaaaaagaaacaaaggcacacagaagttagatgatttacccaaagtcccatagctactaagtggcagttttctgaaaccaggcaatctggctttggagtccaacatcttaagtactccactgcaatgcagatgagtgatggccaagcagtttaaaaaaaaagaaaaagttattgtctgcagtagaaactggaggtcagggtatgggtaccttgggcaaattacttaacctcttggagcctatttttgcatctgaaaaatcaggataataattgtacctgccttgtagagctgaggtgatgattaaacaagattaggcatgtgatgtgcttagaaaagtacttggcacttttaagagctttctgtcagccattattattatttgtattttaaaacagctcaagtggtcagggagaaatgaaaatctattaaactgaaaattttcctgccaatcttagatttgtagattctgtagattaccagtacatcagatccaatatgaaatgcagtcataaaagattttcacaaaaacttaaggactgtcactgtgacaaaccccagcccaaacagtccaggacaatggctctaaaaagcaaacatcttcaattatcaagctgtgtacatgtaaacacaacaggaaccagacttctgagtagctgcaaactgcagttctctgtgatgggagaacatgccccagaacagcctgtcaagtggtaattgccagccatcctcagtcacatatgtataaacagaaaagaaaaacaaaacgagggctcaaataaaaagcgttaacattcattaaacgcctgacactctattaaatgtttttcatgcattaccttctttaatcctcacaacacccttccaaagttgaacatgaaacaaccacactggtttatatcactttaaatgtaagactacacgtctcaaatgggccctgagcactgcctgggaatccaactctatttctctagtacgctcactttcaccctctctaggactctgtcacatatctctcctccaagttcccacacctttcctctcccccgctgccctccctctaagctgatggatgcctataccaatagactcttttcccaccacccactgtatctgcacctgttatctcagcttcccctctagttacaacagagtaagtgtccctgctcatttcaaaaccaactactcacctgcttagggtcttctcctttctcaggtattcaacaactaccctttacaatgttcccctctttcatctgcagcagtttttcctttctacgagtttaatcacattgccatataaacattctgctttcttctatcttgaaaaaaactctacccaaccttaaggcccctcttccccattaaagttgttcttgtcaaaatgattaaaatcctcctaattaccaaaggcatcttatacggtaacattcaacatggttgaccactacctccctcccttttttggcttcgcctcctcttctttgtgtacactattaaactagatgtcttcaccagtcccatatattttaaatactatgtacagtatatgatgccgattccaaaggttaactctagcccgacatcctccagaacttcagatttaaatttctaaaaagcacatttgatatctcaacccaaatatctactagataatttatgtgtgtatatttcaccatactaaaaaaaactaccaggtgactgataaatggagagaaggtgaataggtaatgtgaaaaatcaaatgtgctaaatattcatggcacctgtaggtggtaggtggtcagagtcctctgcaaaattcttcccagctatgcttatgtcttctattgggaaaaacctactgggcatctcaaacctaacacattcaaaacataagtactgattccacaacttccaaaaatgaaacctaccccatcctacagttttccttgagtcaaggctagcatatgagggccttggcatatgggggcattgcctatcgcgttcatagatattctgagcttctagaacagcatctggcacacaggaggcgttcaaaatagctgctgaatggattgatgaattcatgttctttctttctaggtccctcgacctccacccgcccttgagtcattgggaagttctgggctgtctcagcgcctgatgatggcttcttaccaatcataccacacggctgctcctcagggagttggtggcattcccctaccacagagccacagggttcctgtcccggtcccgtctcgcataggcgccccaacacgcgtcacagtgcagctggcatcacacggccagaatcacgtcctgccctctggctgcagcgacactacttcacagctcaggcccacccgggcagtctcccgggccagggccacaacccacgccttgtgacccctgcacgtcaacggcatcttccttcttcacgcccgccctcccacagcccggcgcagcggcctcccgcacgccccctgcccacctggcccccagccacctttcctcacctgggcctgcggggccgccccaactgtcccgctgcaaccccagcagcctcgccagttgggtccacgcctagcctgccggccttcgtcgctatccaatcccacctgcgcccgcgagcctgcgcactggagctttgccctgcgccgcggcactctgccctgcgccgcggccctctgcttgccaggccgggagagacagaacctgcctctaccggtcttccaaggcactgagagcccatcgccgcggacgccgctgtaaattccctgcgggccctgtgcaccaccctgtgcgcgtccccctctcccaggccaggctgataatgttaacagctctctgagctatgctcatatcctgaaccactgaggactgtgttctccaggaatgctcgcctgacccacgcctgccctctaagcccctaatgaggccccagagggctggggtgggggggtctctttgtagtatcagagcagggcagataggcaaaaggagtcagagcctgtgccagaatatgaggtcagttggctgctaggtcaattaagacaacttcagcaagggtggtcaatgtagagggaattcaatcgttggcattgcctgaaaacaggaagccagaatctttttatcttgacgaacaaacctctattcattggtcctgacctgagccactttggtgaatccagataccctgaaggtgtgacaagacctgcctcacttatcccccagccttcagtgctggtcccacagagagccatatgcttgagctgaactgcagttaagcagtgacagctaccctctgtccaggctctgaggccagctttctgctccgtgagtcactgacagtgagtctctacagagactttttctttctgtagcagccaaggtaccctgcaagcaacccacgccattgccatatgtcttagtttgtttgtgttgctataaagcaatacctgaggctgggtaatttataaagaaaagaggtttgttagtttcacagtttcacaggctgtaaaagaaacatggcaccaccacccgcttttgatgagggcctcaggaagcttccactcatggcagaagacaaaggagagccaatgtgtgcaagacagaggaagagagagaggtgggaggtgccaggctcttttccatgaccagttctcatgaaaacaaagactaagaactcactcagttccatgagactagcaccaagtcattcataaaggatctacccacatgacccagacacttcccaccaggccccacctccaacattggggatcaaatttcaacactagattttatttatttatttatttattttgagatggagtctcgctctgtcgcccaggctggagtgcagtggcgtgatctcagctcactgtaatctccacctccccagttcaagtgattctcctgcctcagcctccccagtagctgggactacaggagcatgccaccatgcctggctaatttttgtatttttagtagagacgaggtttcactgtgttggccaggctggtcttgaacacctgacctcaggtgatccgcccgcctcagcctcccaaagtgctgggattacaggcatgagccaacgcacccagcccaacattagatttagatgggacaaatatccaaactatatcaccagggtaagattcccctttaaagatggaccccatgtctaatgtttcttcatagtgcctaacatcaagattctgcactggtcatcatttcacaaacatgagcagcatggctgctccaagacacacagagggaataacccccattcacatcaccaggaaatccttgcatggaggctaaatgaacagttggtaagagtggaccctgaggtgtcattccatctcccccagacttcctgcttgaccacacaatattcccagaagccagtgacccagaaggctcttcttggctttctgtccttttacctgtgaaaaattcgaagaactataaagtttagggcccatcacagtttactacccttctttggaggcctctttaaacccttgagtcttaccaattaccagtagcactaggagctttgcaagcctggccttaagtccctgctttgctactgaatagttggtgacctttggcaggttacttcccaacttgtgtctcagttttcctttttttaaaaaaggagacacagttgcaagtgtttaatgacacaaaaaacagaagcattcatcaccacgcctggcagtgaacactgcttttcttgctcaagaggtttgagccatacgcttctctaggtctgtgactctcccagagtttctgggagttcctctgtgagcaacagacccactgcagtctccatactttaggggtaagcctggatgcccttcacacatcagtctggatgagttcatgcaccactcatccaaaagtgaatccaaaagtgattccaaaagcagaggccagagatctagttgctaatgttgcctctcctcatggttctaggattcagccacacagggcttcccattgcagcttcaggtcctcctcactccccagtgcaggcccagtttcactctcaggtcctccagcccaggcctcagttctgcctcttttagtccatccctccagatccactttccaacagggctgggaagtcgcttggttgtcccctgcctgctgcaccacagcccccagacaccgcctccttatttcctgcatggtccgaggctcaatgctaatccctgggtgtcttagtctgttttgtgctgctataacagaattcctgagcctggataatttgtaaagaacaaaacatttttttctcacagttctggagaatgggaagtccaagatcaggtgccagcatctggtgtgagtcttcttgctgcatcctccagaggagaggaacattgtgtcctcatgtggcagaaggcagagagcaaataggaaaaaggaaggcaaactcaccctcttctaatagcattaatctcacccagaaggacagagtcctcatggtcctttcacctcccgaaggtcccacctcctaacactgccacagcagcaaccaaatttctttgaatattaatacatgagtgtgggaggggacaaacattcaaatcatcacactgggaaggctcagctggaggagcagaattggccagcacagggaggtaatgctgggtttggaatttttgtctttgcagtccttggccttgatccggatacccagacgccctctgagatggaccttgagggccgtgccaatgtctgctctctgctgaggtagggctcatctactccttacaagtataagaacttactgccaaacataccctcctccaagccatgggtccccagatacagtcaggaggaccccagtggatagctggaactcaggacctcaggagagatcccaaggcctatgctcgagttcagagttttctaattcaggcttggagcccaggaacagaagataattaagaacaatactgacagaaaaaaataatcacttcattgacattacccttcacaggaccgcctgcttcaggcctgtgctttgcagcctggttcatttgggaatggtatgcttcacacccagccctgttaagtgtgagttgatgaggaccatgagcttggaagaagccgtgggggcctctctgtgtgtttctctctgccctgctttgagacacttcacataaaagactctataaaaataaactgtggagatttcaatgccagtaaaaatcccagtggaggtagaaaactatttaaagagcacaaggacatacatttatcttgttgtgaatccccggctgcctggtccctgagcctgacacacggcagatgcccaataaatattaatagattgatcaatttgttggctgctcatccatttgcagcttcagccagcccatggctctgcgtgcacacaccacaaggagagagaatccatagacttcgacaggagagagctgctcagctggcaggagagcctgccacaaacccttgaacataaatgtcctgccctccacttccagctctacgtactaactgtaaaataatgatgtggcagaaagtgaagtgcaaagactgccaaattctaagaaagaacctggtttcatgccttttaatccttatgagtcattccttggtctgcgccaagccctgtgctttacagcaagaatacagatgtcttcattgaactgcatctcattagctggacctaacagagtgcaaatttctttccaatgccatttgaactcaatgcccagatgcttttttcccctgggcccgtgcagatgaaatcttgggctggtttataactttgaacacccagaatattcccatttcagtttaagattccctctgacttatctaattgttaggctctcttcaccttcagcctgagaaatgggtaccatcaatttctcctttctcacccagcttcacacccaggccctccagactcagtgggtgtctgacacctctacagctggagtccttcagcaatgggccccctgggctcagcagatattttgagctggccatttcttctgtgagacaatcttgtgttttctcaggaattcccctgcagaagatctctgagtacaaacccatgcccagtgatgttgcctctgcccagctacttacaagaccattcctcggcccatccagggctaccaatctgtttatgtaatttgtgccatgaataaaggtaccagacaaatgagtaagtggaggctgagttgtaggcatggttttgtgccccaataatgggctgcacaggaaaggaagggccacctttgtgtaattcataagctacaggtggatgcctttttgtgattccccctaatgcatgctctgtgtgagctgaggctctggctctctctctgctggggtcaacatcacccctgcttgttttacaggctatgacctgcctgcagcttacttgcctacataaaaagggcatccgcgcccttgccctgacacagggattggcggttcactcctagcgccatcctctttctctttgctctcccgccagacatgttgttgccgtcatcacctctcaccatgagattgctcagggatgttccagacaccaagccctttcagaagacacatgtcaaaccctgtatatgatttgagcagtctttctcatgtggctggagggaaaggagaggtacctcattcctctcccctccacaaggaggggaaagaggtatggaaggggaaatgtcatagcattccaacaactcttttcagaggaattttctactcctggcctcaattttttataaaccctcatgggtgtgttagtggtggaagttatctaggttatcggtggcaaacctgtatgggtctgcagcaatctcaactcttgcctcctcagaagaaagaatctgaggtgcataaggcagaaggagaggccaagacaagtgttagagcaggagtgaaagttcattaaaaggctttagagcaggaacaaaaggaaagaaagtacacttggaagaggcccaggtgggcaacttgaaggacaagtgccccatttgaccttgaacctaggatttcatatgctgaccgacttccagcattttgcaccccatttcccttgatttttctctcagggtgagctacccacatgcacagtggcctactagcacctgggaggtgagcatgggcagtgtgtttagtggagctgtacgcatgttcacctgaggctttcttccctttcctggtggaatgcctctggaaggtcatactctgccattttgcccgttaatgtgcatgcttgagcccacttgcccaattcctgaaagctgccagttacagatgtttttatctattgggaagctgcctctctctggtgctggctgtgaccaattattctttcagagaggcaatgtgacaattgcctgaccatcacctgttggttgcctgacatttcttgttggtgggggtagccctctcctgctctgctcctgcctgactagctacctaccaggaactccaaatgactgcaagagagagtttggagatggtccaagagctgggattggaattggagaactaggttatagccagatactggagagtttcacatgccatgctaagaaatttgaactttatcccataggattgcaggtgaacgatattcagcaggagagtacctggtcttatttgcctctgagcatgctgggtggagaggcatgatgaaagtggagacctctttggtgtgcactaagtaggttaataagcaatgttcagagaatcttccattcaaagtaaaaaaatttctcacctttttttctcatttctcaaggtggtttctaattcggtcttgagagccagacattcttcctggtttgggttttgtattcttttatgagttcatcaatcaggtgaggccacaaggggagacttagtgctcaggaacacaaaatctattatactcttgggtcctagagacagcaggcacagcaggccacacaggaccacatggggaagacaccagggtggccaggagactgaggacaggagcatgcatttgatatacaaactaaccagcacagagctacatctctatctggccctacgctccagagaccatattcctctccttaatcatcccagggccaggtacaagacaactagaaaccgtgcctagagccaaagcccgctggaatgattcaaactagctagtcctaagctgttcaccctgccttgccttgcctttcccatggaaacccggtaaaagctatggcctaggtggccccctcacctgtcttctgcctcctgaccaccctgatgtctttcccatgtggagtggcatggaatgcctcctgtttctaggacctgtgtgtatcataaactttattttcctgagcctgtcctgggtctcttcttgtggccacacctgactgaccacatcataaaagaatacaaaacagcttgccaggtccttaggtgggcagcatgattgagtgagaagggcataggcctgggttttatttcagtgcctttatctacttgtggcctcagacaaattattgaacttctctgggtctcaatttcctcatctataaaaatgacccttgcagtgtacgagtcagaataaactagattatgctgctgtaatagataaaccctgaatcttagccacctgtatcagtaaaggtttccttcttgctctcagtgcatatgcagtgagggtcagctggccactctgctccctgctccctgacttagcacacaggctgatggcacgcccactgtctgtgatcacattaggatcttggtgacagatggaaggagcactctggtgggtcgtccacctgcaattaaatacaccggcatggaattggcaatccatgcctctcctcacagctccgtggttggaaatcacatggccctgctccaccacaaaggggccctgtgtgactaccacagatgcctactccacaggtgtagggtgagggttacatgggctacaacacaaagagcctggtgcagggcttgaaggctggcaggttctgacaaaactcttctaggaagagcagcctccacccacagctgtggtcaagactaccagattcgcactggcaagtactttagaaaaagcatactgtctacagtaacactgctaagcatggagacttatttatttatttttgagacagagttttgctcttgttgctcaggctggagtgcaatggtgtgatctcagctcactgcaacctctgcctcccgggttcaagcgattctcccgcctcagcctcccgagtagctggaattacaggtgcccaccatcatgtctggcttaatttttgtatttttagtagagatggggtttcaccatgttggccaggctgctctcgaactcctgacctcaggtgatccacccaccttggcctcccaaagtgctgggattgcaggcatgagccaccatgcctggccagagcttttcactttaaaattatttcaaaatggtaaaaggaaatctgaaaagtccagtgaaggaaaaccacttgggaaacagaaatcccaaagatcaggattgataaatgtctctatcttcgagttatagacagagagggctccaaggacaaaatttgaggaaagatggttgataatctcttgtgtaagaaagttttcatttgcaagaaacaggcagagcaacttaagctggcttaagcatgcatagactgattgccacaggagctccaagtcccgctgcatgacagggttcagttggttgattcagttataacaactgggaccccagctctcaccattcttcctgctctggcatccagagtgttgatttcgcttggcttcctttgaagacagatcccttttaaggtcatggaaaggctgtcagaagctatacagtggggtagataaataattgcttctggaaattttccctaaagatgtgtgggcacttttctaaaagtccctatgaaatatttgtgtgtttcactggcttaaatttaactatgacttctgtccctagcaagaagggttgccttaaagccaattgggccttcccttctcccccacctctccttaacttcttgtaaccactaatccattctccatttccataattttgtcattttaagaatgttctataaattgaatcatacttgtactacctttggggattggcattttctcattccacataactctctggagtttcatagaagttgttgtgagtatcaatagttatttcttttgatatggattaccacatgttacttagccattcacttatttgaaggatatctgggttctttctcatttggggtcattacaagttaagttgctatgaatattttcgtaaaggtttttgtataaacacaaatcttaatttctctaggataaatacccaaggtgcaattgctgggtcttatggtgatcgtgtgtttagtttcgtaagacccaatcaaaccattttccacaatgtatacactattttacattcccatgagcaatgtatgagcaatcccctttctccatgtcctcagcagcattaggtgttgtccttattttttatttgaccatcctgatacatatgtggagatatcttattgtagtttagtttgcatttccccagtggctaattgaagttgagcatcttttcatgtgcttatttgccatctgtatattatcttcagtgaaatatccattcatgtatttttcttattttctaatgggatttttttcttttgtcaaggttgagttttgtgagttctttatgtattctaaatactagtcctttgttccggatacttcctcctcatttgttgcttggatcttttatcctcttaacagagactttttacagagaaaaagaataaacaaaaaacaatttgtcaagttttccttttctttttacagatcatgcttttggtgtcaagtctgagaactctttgcctagccttagatcccaatgattttcttcccctttttttccctaaaaatcatatagttttgcattgacatgtaagtccaggatccatatggagttcatttttgtacaaggtgtgaggtttaatgtcaatgatctttttttttttttttcatctacggatgtcctattgttccagcaccatttattgaaaaagcaattctttcctcattgaatttctcctgcattttgtcaaatatcagttgggaatatttgtgtgggtctatttctggattatctattctgttccattgatctatgtgtccatctttctgtctcactattactgtagctatatagtaagccttaatattaattacagtgattcctcccactccactctactttttgaagattatagctattctagtgcttgtgcattttcaaataagtttcagaagatatttttatttgtataatgtaaattacattatgaatatacaataaaatttataaaattaatttcagaacaaactcatctatgattacaaaataccttgctaggattttggtaagaattgcattggacctataaaattaatttggggagaattgatgcttttactatgttgagtttggaagcccacttttgcactacaatttagtgctgaatatgtatatgctttagcaacctcataacaacggtgtgctggcacataataggagcttcataaatatttatggcagggaggaaggatgggaaggccaagtgaagtcttgaagagtttggatcagttgtccttaaatctggccacagaaacaaccatctgctgagcttggtaaaagtacagatttctgggcttcatctcagccctactgattcagaatctccgggatgaggccagtgaatctgtattttgaacacctgctatagttgatcctcaagcacagccaggtttgtagcatgtagcagccaacaatggaagcagtgtgcaggcgctgagctgagtctcctaggaattagctgttctttctgacatttgccctgaaacaaagcaagtggtagctgcaattgagtccacctaagacaaattaacatgttcttcctgatatatggctcaaaatgagtatagcagcctgggagtcaagggtggtcctttcctacaaggaggaggaccagatgtattttgagcctgtatccaccaatttcttttccaaagaggaaataagcaaccaatgttcagcagaatgtgagcagttcctaaattgtaaatactgttatttaatcacttcattgcatacttgattagttccctaaccttgaggcctgtgaaactgtaatgatgcaccaggggagctggcctcagctctgagagaatttagaacaaggctgttcagatccctggaaacatctttttcattaatagcagaagaagccaaatgacccataagatttttctgtcataaggagaacagaaaaattagaaacaaaagcacatagaggagagttcatgaattagattttagagcacagacttttttaatcttagtctttgtttttgtttggttggttattgttgctttccttctcttattttgcagtttcagtctctttattttcaatgtaaaatttattatataagtaatagatatataaaggtaatttttaacaaaataaagtgtattctcctaatcccatcacccaaactttggtcaatttctgttccattgctgagcctcccctctgttcacggtgcttctccttgtgcctgcgaggcattccatagttgtaaccagcatgtaattctgagttattatatcaaacactttactaagttgcgagttcttcgtagttatattactttcttggcagtgcagtattctattatgctattgtaccatcattttctctaatgttatcattattctaatgcatttcagccaattccaatttgttgtttttatcaagagcactacagtgaacatttttaaataaattgatttttttcttattctggattatttctgtgggataattctcagggatttcattgttgggtcagtgggtatacccatttttatagcttttgatatttctgaatatgccagcttcagcaaaattttgccagcattggacagtttttttaaattttatgaatgtaatgaatgcaaatcagtatattgacattgttttggttagaatattttgtgtgtttgttggccatttgtattttatcgtatattttgtctatggaaatcctgtattgatctattataaattaaaatgggctttctaaatattaaaaatattaatctttgttcacaattatgtaaatgctttcccaacccattgctattctttttacatgagttttgtcattattattgtatggaagtttaaactttttcaatattgtcagctttgtaggttttctgttgttatacttttggtctactgcagtaagctggaagagtgatcattcctctgcagatctgataaaacgagagcctgtttcctaccagtctttctctgatgtgtgtgtgtgtgtgtgtgtgtgtgtgtgtgtgtgttttatgtgattctagtagatgaagtgggctttgaaactgaatcatttttccagctctcccagttgtatcaatgaagttgtctccccttcccctatgctgagaccccaactttgccctgctttctctgttacacagcaccagatatgctcctgggcctgcctgtggtcccccagtgtttcttttgtgcatttgctaatccatgtgtctttagttctttgtcctaatatggggtaatgctggatctaacacatcactctgctttctttactagatatccccatcttatttttccttcatatgctttgtagaatcaggtataaagtccaaaaggaaagtccttttaaaagaatgtatagctatgtggagttgtatagaaaagatacagaaagatatcaaaacatattacacccataaccttggagccaagccccttaacagagtccttccactgtgataaccataaaactcctttgttccaaggtgaactatgaagtgcaccctgcaacactgtatctgtcccggagagtgtgtgccagtgctgcagcaagacttcaccctgcctggggtatcttggaggaagagattggttctcaattcctttcacaaagggaagcccccacccccttctcaccacctccccttcccacacacacacacacacacacacacacacgcgcacaaagctttgctggacgtaaaccccagaactgaagagaggcaacagccatgattcaaaatgagtcttggaattgacaagcatgctcttcttgaagtgagctcttaacaactgggccaggcccttcatcccaggtcacctttgcaggagcctacaggtttctttcccagtggcagagctggtgggtacactctttggaccaaggtcacctgagggctcttctgtccaaaggacctccatgcagaaaccctcagtctctgcctcggaagacggctgttctctgtgtttatctaaaacaataagcagcttttaatgggtgacctcgtcattttgccagtagccttccctaaacagaacagttccgtcctcttcttaatcccactgagcaagggagttttccttagcctcataaaagagaaatattttgtgaaggaaaagtaggactcatgccactttatggaaagacctgtgttacacaaattcacatgaaagacacattctaggggaaatgtgaaaagccaccaaaagtagaagcagacagatgtagtgtgaatccacctgtcctacctgtatgagctcaggaaattaaatcttctaagcccccttaatttttttttttttttttttgagacagagtctcgctctttcacccaggccggagtgtagtggcactatcttggctcactgcaagctctgcctccttggttcatgccattctcctgcctcagcctcccaagtagctgggactacaggcacctaccaccacgcccagctactttttgtatttttagtagagatggggtttcaccatgttagccaggatggtctcgatctcctgacctcgtgatccaccctcctcagcctcccaaagtgctgggattacaggcgtgagccaccgcacccagccctaagccccctttaaaaacagaaataagaatatcactcaaaactgacataaggattaagttaaatcacatgtagaaactaccttaagacgcactatgactgtcttaatgtctaaaaggaccaaatgaaataattggtgattaggtttaaaggctacactgctctgtaggcaaagtcctctttataaatgagataatatatacagtggagggggttcagcttataggggttatagacactttggagaatttaaaggctgttaagacctgtatttcccaaaagaagcacacaagtcaacattctaggtgcaatagcccatagatgccatgaagaacacctgtgggctgctgcatggagccaaactaagaactcatgccttgggcactcatgttggcacacccatcctctgtctgcaggggagggtgagacctgttctcctttttgtgcaggatcagtgattctaacaggactcaccctgagcacagcccatgctacagtccatatatagatgagggcatggtagagcctggcacccttgccataggtgagtgcttctccccacccagacccataccacatgttagggcacaagtccaactgtctggtttctttgactacatggaaaaaacccaacaggattgaatgcattaaaaagcttatatcttctcactggagtaattctctcctttgtgattgatgataaaaatagctaatgttttttaagcgcttaccactacacacctggcgttgtcataaccgcatgaagtgggtttggttatctggcagtcagctgcatattgaatggtttaaaagtcatgtgctgcaggtctcccagccagtgagtggcagggccaggcttcaaatctgagctcccccaaccacaatgccacatcttctgcctttctcttcccggctggctcagacgcactgcagatctcagtggactggcccttgtggtccccaccaattgctcagccttcttctttctgtttcccagccctgcggagccagctccaagaagactgccccctgcatacaagctgcttcctgcttgcccacatttctgtgaatccataacgtacactcccaatgctgtaaagtgttgtacttccccataaatgaacatgcacagtcttcaaagcctctgaatcttccactctattaacttgttgcttcctatttcagataagaaccagcccttttgttatattttaatttcaaatatccactctccttatcagctggcccaccactgtcctctgaggctccagctcaatcatttgtggtggctgagcttccttatgtacagccaggaaaatggagctgggacacaataggaggaaagttaaggagtgggtttcaattatacttgaaacttctcaaactgttgtctcgttaagtttcagtggaccttgaaactgtgtttatgtgaaagtttttggaacattcagcatttttaaatatacactgtaagtactttaacagaatgttgagtggttacagacctgcccagaatttaacctcccttcctcccagtgtgacagtttctgttgcccttactttttctgtgtcctcatcaatatgttctgaccctgcctggtgaccaggtcagcttctggtggctccttgcattaacagtgagactttcctgatgctggtctatactcagccacagcagtccaacaagatgggccctatgacaggacaccaagactcttctctgcagtacatccagcagaggggcaggtaggagcaggcaaaacaggaatcagcactagacattcagacccccaaaagagagagacctgaggagagggatgcacactcctgtacataggaggcagaacagatgggtgctcgacaggtgggccgtggagtggggaaccgatcaggtttgaattctagttctgtcacttacttattggataaccttgggaaagccccaaatgtgtcatgtgtgaaatgggggtgatgacagtccccatgttgtaggtcgttgtcatggtgcaagggccatggtaagtgttctgtgaaaatggccattacaatgacgcatgacccccaaagaagatgcaggggaaactgggcaatgcccacagaccatcccccacccccagttgaagtggcttgatagcactgagccctgctctggtcagagctcagccccagttcacccagccagagtgacacccacctgagggcaccgtattccagggccacaggctcctccaggtcttcccattcactcccactctctggggactcttctggaggcaaagactctgggacagtgccccaagagcagaactgtggcaagggaatggtcccagaatctgcctccaaacattcttcacagggtagctggccttggcatgtagagttgatggtaagatactcttcatcctccgaggtgggagaaggggctccacatggatggtacatgtcaccttccccatcctccccatccaattcaggactagaatacagaagcccatgtttcttccagccttgataaaaaaaattcctcaccccaccttccccttgccttttagaatactctgcacgacacaggcccgtgagactcagccagtgttcaaacagctcatgccagaggctgctctgggcaccaggaagcaagaaacttataaggcaccaaccctggctttgaggagcccccaatttaatgagaagttggagcagtaaagaaatgttacagtccatgtaggaagtgctatggtagaggcagctggagcaccttaccgagctcaggagaccaggggggtgggggggcttgccagagggcacagcattgcaagcagggcaatgacccagttctaagacagactcgtcacatggcaagcagagtcggtcagactttggacaagtttattgacttctttggaacctcagttttctcatttgacaaaactagatggtcaagaagcatctaggattattgggacacgtaaattacataattctgacacagcccccccaactctgggttcctggtatggggtaagtttttagtaaatgtgagatgctgtgattagtactgtgaatatgatggctatttcaacagaagaattataaagaaagggcttcaggaagggattgggagtgactcaagcaggcaaccatcaaagcactttgtgcaaagatcaggtccttttctgagcactgaaaatttgcctatttagagatgcggcaagctgaagtgacatttactccccgcggaaggacacaggaggcagacaagtggtgaagctcattatctggtgatgcagccgcagacgtaatggtcaaagaacaagacttccaggggctgccccaagttcgccacacacgcctcttgattagaaagaatagtccatgcaaaggtagggcattttacacagcactgcagacatgcagagaaggtgctcagaaaatatctgtcgaaagtctggttagaggagatgagaaggaatatctaagagaaaagcacaaagatttagcaaatacatggatcctcatttctcagcctccttacccccacccaaatcaatgggttggctttgttatgtgctgctgctctccttctcctttcctgcattgcctctttctcttaaaattggctctggtgcaccccaatagctacaaacccttagatacccagagagcacgtcctcctccccagtagagccggaagcatctgtcccaaactgagcttcactgtgaaagagacattatttccactcatgagagctacaaggtatgtgaaatagtgaatttcatgtaaatatatgcacactcaagtgtataaaaaagaaattattctacaaagactgaagaggaacactcactgtcaaaagacatttttaattcttgagcatttgcagggaaaattgactttaagcttggctaaatcatgtagaaactgtgttttcttataaacatgggaaagaaacattcaagaagttttatcaaagaatgggaaatctagcctattgcccaggcctaggctcaccactgtccccaccacctcaagcagcacccccttccctcctttctgagctcactaagccttgttgaggagtggaagatggcagctgtatgtgtccattggccactgcagctgcctcagtgtccacacctcacctcccacccatagactccctccacctcttctaataagctccttgccctctggttttgattctgagctccagctactggctctgcctggacagagacctagagaagccatcagcctgagaggcaagaggcaaggcttcatctgaggttcaaccaaagaaaaagcgatttgctccccacttgtccagggggacttggtggtcccaagggtgaaatcgtggccatcatcccaccacaagttgggagaacgactgcctttccttctatccttttgcacgtgccatcaggctgcccttggagatttgacctggggctcaactgtggacatagggaaagggtgaatagggaataaagaggcaccagaagcctgtatgcctatttcacagaaagggcaagacttggaaatttggagaatttcattaagatagagacattctttcacagcaagcctcatgttttgcatgtggacatgatgggtaaagaggtggagttcttcacccagggttcaaggccggccagctcatggctaatgtagcaggactttcagcaagaccctgatgctgtcggagtacacggggctctctgctcaccccctgattctgtgtaatgatctcagcttcttcctgccctcactctctgcccaccaagctgtccaacagaaggaggcttttatagacagatgataactagaggagaatctggagatttcacttgggcttcctggccagccatgtctcccatacaaaccagcaggaccccagaaccagggtccccaccaagtcctgaaactcttcagtgggtatttttaagaggaatcccagttcagctctgaagtcagtgaaaccattctgaaggctctgcttgctacagaatgtttactgagaaaagacactgtgcccaacttttctggacagctgtcctttaaagacttgggccaccaaattcatctctgcctttcaggaggaaattcatagaagcagattgggcatttcaggcttgaaatatgaaggtattataattgtcctatttacttacggttaaactcacaacaaagtttggggtttgtgtcccttcatgtctccagttctccaacatcaggccccatactgatgtctccattagccctgatgacacagctgggagccccaggtctctgctcctgacaactgcatttagttttggcaggttggatttacagtatctctaagacatcaaagtaaacaagttcaacggactgccagatttgaagctcagatgataaatctgagctgaagtacaatacttaggatttgtcacagtagtgtggacagatacccctgggtatctggggatacccaaggatagccctgggagcctgtaaggtgtaaagagaatcctgctagaggcagcatccaggatctagcccaggctctgccgcctccctcactcccctcagccacactccaacccaagagcaggcatgacatctccctcacctggcaactgcatccctccctaactactctgacatcacacctggcctggcccctgcagttgagtgagatctctggcctcctaattatcttttgctattccaggcagtgcccttccccagaaggtatatcataactttaggttcatttccaggagtcctgcttcattttgctttcttaaataaatgaccatcaagatttataccatcactttcacaaagtgatgcttgtggaacttacgtgcattttacttacatgagtttaatgatatgtgctaggcaaaaagagaaagagaaagataaccttaaacattctgcaaagaccaactttccaaccgataagtgtaagccttgaagtgcacatgagtgggagaactaaatctttcatcctgtcaatctgtctctgtttctattgggccagcatttaaagacaaacattttgcatacagcatggcccataaatgcaagcctcctaacttcatctgaggctcgaccaaacaaaaagtgatttgctcccacaccaaggggcaaataacatcactccttccaaagtgatgtttcaagggtaatgagacttgatgtgattgttgccttctgcctacctttaggaactaaccttataaaaaacatgtctccagccaagctttccctctgataggcacgtaatccaactctccttcataaaaatgtactgtactgctttattacaagatatttttataaagatctactactagatggtaaaatctctagatatagagtgtgagaaaagagaacagggaaagaaagtgaaatcgaatcttgtccatgaacactttgggtttgctgtggtgctggcagccatctggctgtaggaaattgccacctggcagatggtaagttccggcaatttgctgggaatttcaattgaagggacctgttctttagctggaaatagctcaggaaagggaaggaaaacagacttgcattgagttcttaccgcatgccaggcactgtgacagcaccctgagcgtgctatttcttttgacctgcacagtaccctgtggaactgtcatggtccccatttacatttgggaagcctccagcttagggaaggcaacgctccaggcatactagtaagtggcaacgctgaaaccacataataggatacagaaatccatgctctttttgttgaagagtttaactcacagatgccagacacttaagaggcagtggcctgcgacagtcacctcagaactgagctgcaaacacttctaaggcttctgcagagtcacaatcccactttggaatcctgattcagaccctatccaggagctgggggaactgtgtccaggggtcgctgggcatgcgtccctcttttcttcctgtagggggcagccactatgtgtgcattaaatgcaaactgacgtcctattggaggagaggtggacttggtttgagttctttcagaggggaggaaaggttcctaagtgagggagggaaaacgaagtaaaaataaagccaggaaatgtgatgaggcagaaagcattcatcaacagaactaccacagggaggcaagagaaaaagggggtgcggttggccattgagagagccaggataccgagaacagtaaagctgcctgcccacagttcatccatgggtacatggaccatgtgggcccggcagtgagtatgatggttgatgggcgttcacaacagactgaagataggagactcccctggaatgctctggacaagcccttgggactctcgtgtggctctaaaaggagcagtccctccaagaatgacagattttggacatctggtatacccttgcaaatagggccactaagccaaatttaatttggttcagaaaaacagaataatgtgatgtttgatgaaaaaaaaaaaaaaaacagcaaatgctaacagataggcagaaataggtatccggacttggaagtagaagacataaagaggcataaagatgtggaagatgtgggagcaaatcactttttctttggttgagcttcagatgaagttaggaggcttgaatttatgagccatgctgtatgcaaaatgtgtaactttaaatgctggccctataagaacagcataacagcataaagatttcaccttaatgtaaggaagaaccttctgatcagtaactagatgatgataaaatgggtcattcaagaggtagcaagttccgcatccctgcagatattcaagcaaaagctgggaccccttcttcaggaatgttatggagcagattccagcatggagtttgaggctagactagatcatttttatattgaacaggctgattttctgtagtttaatgaatgaaacagtgactgcctatactaatagtttaaaataccattttaaataactattggctatattaaattaaaggcacttggcaagtcaaattcccagcttgtacctatacccagggtcactttataattcagctctcagggtccctgttcattatcccaagctatctggcagcaaaacctttcaatatccaaacaagtgcctcctccctacaggaaagtaccgttcctgtaatatatcctttaagatcatggtaatagttgtccttggacaagtctctgtaggttactttctttattattttatcaagtatgtcaattactgcctagactgcaattgtaaagaactataaatacacttatgttatacattatcagacaacgaaagtgaatatcattgatgaatgtgcttgttcaccctgttctactttgcaaaccagttagcttttgtttggctgacacagcattcttcaaaaaattgtagcagggtacttttagggaatgcatgcctggctcctgcttgtcacagctctcatcgggtccaacggtattacacgactgcttcacacttcacagagactatcatttcctatggatctacctttgacagtcgtctaggatggctaccaaatgagagccatttaatctcagtgggtttatagagtgtcaaacacaaacaattgccccttgttatttacctgctttgtgcccatgcctctggctggcaaatgctagaagcaggtcttaccctacatgtgcagccctctgtctgctctcaacaggtttccaagcaccttgtgtaataagtacttgtcaaactgaatcaaagactatgtgttccctcagcataggactgagaatcggaaatacttacagatggatggacacaaaaatgcagactaaatttaaaatgactgtgaaaatgaatgttgcagggtggtcttgaagatatagatgtgttcagaaaacaaaagctggtgtagccaggcatgatggctggtgcctgtagacccagctattgaccggctgaggtgggaggatcacttgagcccaggattttgaattcagcctgggcaacatagtaagaccccatctttaaaaaaaaaaaaaaaagctgatgttgataatgaagcattatactagcaatagaaacgaggatgcatgtaggaacttccttcttactacaaagctttaacaggccatggaagatacaagagaaaggtttgtgtgccaggagaaaacctgaggcctgccacctatagcttccaagacatattggggacaattgtggtctgggtagggtttgctttcccaaaagctcacaggtggtcacagcagcaccagaccttatgcttctcttgttgcaacctctcttctaaatgcctggaacagtgctgggcacaaaatcatccaagcatagttattgatggcttgattacaatttcctagcaatgagatgcacatagtttacaaaatgtctgcaaatgtggtgattcttaccttccaagtctcatgatatcacaaactgaatagcagttttgcctcacatccttttccaaagaggtcgccaatgttgattcatccctttcttggtgaagtttgcataaatgagggtgggactcaggagaatgtgtcaaggaactggcccaaggtctctctctgttttggccccattgtgcctctctgatggccttttgggaagactctggcctgagacccaggccttcccctgcatctggggaggcactgtccctccagctgtcctcttgatccaggatggggctggtacatgagtcagtacatgttgccctggtgaattctttgtcagctgagagttcaggtgtctattaaaagaaatgctactaattactggctgcgggatgcacattgtttttttaaaaatacaaagcttttttcccccatgtgattatagatcagagtagttacaagatgggctttgaggtctgtctatcaccatagcatcccagctcctccacatgctcccagctggacactgggcaacacactcaggcaccttagcttagggggctttggaagctctccataaatgtgagccttatttttaaataaaaaatatttgcaaaatttagacaaagataaaaatggaagataaatatgcaaaacaatgactctattccactttccgataagaaatgtttctttttaagtttttcatcttcatctgtcatctcagggcttgtctccctgtctccacccccatcaaggtgatgttctttcctgggtctcctcctcactttcccagacatgacttgcttcgtctcaactgctcacctccctgtcagccttttaggttctggttttgatgatgtgctatgtcttgctgccactgcttgaccttctacagaaaaacaatctgtgtttcagtagaaaactgtttttatctacagcagaacttgctgggttctctgattctggctgtctccactgtctttgagctattttacaactctataaataaacaggtcctttgaaatctcttttgagccagttttaacatctgcctggttccctcactgaatgagttaaataaaatctttaacgtgttcatttttatatctgtaggaatcatgattttaccttttcctgaaaattatcttccagcacttccaccccatgatctccatacctgatgtaatagagcccatgcctgggttcccacccctgccctcacctacaaaagaagaaccaccccaatgagtggtctccccacatttctgattgtacatccctaacaatgagagggatacacctccaaatgtgcacatttatttaattataaatcataaacatttactactcttctgatagactggacattataaaggatacaccaaaaatcaaaattttaagaagaccatattttgtcacattttcatactctttggagagacctccaaaatctgttttctaacctatcctctccttctagctcattatccctggacatgctctccagcaatccttccccactccaagacctccagtctgtggagctgctgcttttcatcattacccccactccccttccctgtcacacatgtcctcggtgtgcctcttattctgcttagattccatggctctgcccctagatgctcacttacagacaaggaagaccctgagctcccacctccttgcccctctcttcctccatcacgtgtcacttgcagattctgagtttccattttaattcctactcaaactgtgtgaacctcacccctgcttctgagcctctgactagattagcttcaagtgtgtgactgcagatgtcaaatgggcagtcaagacttccacataatctttgtctgtgtccttaatcaattcagttttctacctctgctctctaaattatttctcatcttgtctctctcttcaagtttctaacaactccaccctgaccttgcctgtgacctcacagtgagaatggacacgttcagatgagaactcttcatcttcccacagcaaattccactgagcagcctgtgcccctaccccaacttcagcttccacctctcaccacccatttctgtgctctacttcatggcagcctcttagatgagtgtctcttctcaccgtttccacgcctccctccttctttcttgcacccactagcaccagccttctgtccttaccacccaagggaaggagcccacatcagggtccccagcgacctctatctttctaaagctgaagaacaatattttgtcctttcactctctctctcagcaacgttcaacaaagtgtgtccctccctccttcctgagagcttccttgctcattagccctacttacatggagttgaccatgagccccacccttgcttggtttttccaccaattcccaggccccatcttaatctcatatgttgtcccatctctgtaccaggcctctcaatgttgttatgctctgtgctgacttctcagtcctctccttgaacttatctgcactctttcccaaggtgatctcaaccatttcatggctttacacgacctctatatatgctgacaactcccaaattcacttttcccagccccgatctcatgcctattctccacaactgcctaatagactcttcactggatagcctataaacatctcagttttaaatgataccaagaactattgtttctcttccatgcaccccagatggccttccccagcccctgtaagcagtccctctcttgggaactggtaccaagagagatgaagtggaaaataggatctatgattaccctcctaaagcatgaaataggtatatgtgatctagtgcaaagaagagaggtattggaatcaggaaaatcaggctttttaccttcttacccctccttcaccctgcattggtggtagcaccatttccccaaggcttcctcgtgccaaagcttgattgctctctttcctcatgcctgtttctaatcccaaagtagtctcctgaactccgcctcccagatgtatcccaaatctggctgcttcttaacacttcagctacagcctgagtccaagccacatcatgtttgacctgaatgactgctgcttgacctcctttagtccctgtgcaccagtaacccgagtggcccctctgaagaacggaggagggcatttcctgcttaaccctccatgccagcccagtggcttcccactgcatgcaggatggtggcatcatgctcctctgatccccaaggccctccagggtccctgccacctccacaacttcctccacttctgcttcattaacgatggcccaagcacacttgtatttttgtccctcaaacatccaagtgggttcccatctcagggcctttgttcatgctgttccttctgcctggaatgcccttaccccaaatgtgggcatggctgcctccttctcagaggtgctttactttatggactaaatgcttgctccccagagctgctgacccttgttctgcaatctgaccactggagccacccaagcaaatcacaatcctcccacttggccttcgggtatgaggagggaaagctcacccccacacctcacctggacccttcctgctagatctttatgggctctcctgggaggagctattctccaggatggaaataccacttttttccctgggatttcctagatatttcaacaaaaacacagggtcccagcaccttggcctgaatttgtgtgtgtgaaatttggccctctctcacctggttcggtttcttaacacaattgctgctgtctaccttcttttccaacccagcaacttttggatatctttcccatagctcttccctccctagaggctatgtcaaatgacctcttggagtctaagcatcaacaggatctgggacatcaagtcctttatgttgtcctagtgatggtgtcaccctcaggcacaataagtgatcacttttatccacatcctagagatgaggaatcatggggcctagagaggacaggcaactgcccaaggcccatgcagcacagcaggtacaggtgatccaggtacccgcccagatccccctccaggactgagattcgcatcctactgcctcatctcccctcccctggggcagcccacaccccagcgctggttagggcaacaagcaaaggcacaggttctcttgtcccaattcatggcagctccaaggggccatctctgctccagggctccctccagaatcagctgaggccctgtttatagctgcacattgatctctccttctgccccaccccacctcagtcaccctcacaggggatgttctcaagcgcaggccccataaaacctcccacgctcacatctctgctgcaaaatctgtttcctaggaaccccacagaaggcatggcaatgggtaattgtatctgtcaacttggctaggccatggtacacagataggcggtcacataccatctagatgtcactgtgaaggtatttttttttagatgtgatttgacatttaaatcagcaaactttgagtaaaacagattgtcttccataatgtagtgggcctcatgctgtcagctgaagcccttaagaggaaagactgacctctctgaggaggagggagttctgcctccagaccacctttgggcttgatctccatcaattattctctgggtctccagcctgctggcctcccctgtagaattggactggccagccctcaaaatcacatgaaccaattcctataataaatctctttctctcactctcttcatatataaacacacacataaacacacacacacacacacacactcattctatctgttctatttctctgagaacctgactaatatatgtgtcaaggtaaaaatccctattttcctgattccaatggctctcttctttgaaccagactgcacgtgcctatttcatgctttaggagggtaatcatatatcctattttccacatcatctctcagaatggaaattcttattggaaattcccttggtctgcttctgtgtctactctccttcttcccaggcttccctctctgatgcctgagcttccagagagcctggccctaaaagtttcacagccaaagtctaaacatgtaaacatctacaagaagacccaaatgtcagaagaggcagaatcagggagaggaaggagacctactgaggtttgggggccagctattttcctacccctgtgaaaggaggtggcactgaacctatctacaaccctcttaggaccctagagtctggaaaaggggggcccaaccagagccaggtagagagagtagaagacactgcagcctacctgccattcctgctccatctcaggcagcgcacctggagggggtcggcaaaggaggagcgtgacttcctgtggggcccctctcagtaaatgcagcacctcctgcgagaaaccaagattcactgttagatttgggcttgcattgctggggatgcagtgatgttctccccactgcgtcccaggcactagctcctcctccctgcaccttgatctatttctcactccagagaactccggagaaccctgctgtgggcctgacttttcaaagtgcaaggaaccaaggtcagtggcctgcagcttccacaaagttgatgcaagatgctgggctgtgcatcacctttgtgcagcttgggttctgggaacctctcatctgtaatattgcagtaacctcctctccgctccctgccttcaccagtgtcacccacctgcctccttccacattgctcaagggaatggcaatatctgccaataccaatgccttttcttcagagagagaaagaatgactccaacaaatagctgttcatctcaattgccctttcctcccaacctgccctcatcttgggccaccaattttgcagcctccaccatctgaatctctaaagcctgacccttggctctgagcttcctatcagggctcggcttgggctctgggaacctctcacctgtagtattgcagtgacctcctcactgcttgctgccttctccagtgtcacccacctgcctccctctgcaatgctcaagggtagttttccacagtgcagatataactgagtccttcccccactgcacaccctggctgactcacttttccctcaatgtaagctccaaggcatagcacatagaccccgtttctgcctgcctctgcctctcaccacagttccctctctcccatctactcccctctgcacccacgtcctaagcccctgccatgctgaatctgttgctccaagccaccctctcaatgtccagggttcaaggttgcctcgatagctcctatttcctatttagaccaggatttctcaaactcttggcactgttgacctctcaggctggacaattccttatgcgaatgcctgtcctgtgcattgtagggtgtttagcagcatctctgatctctactcactagatgccagaagcactcatcagttgtgacaatcacaaatgtctctggacttaatcaaatatcccatgagaaggaaataatctctgcttaagaactgctgatcaagacactccccagtccctgcttcagccacgcaggacttccaaggggtgcacttctttcctggctcactggtgtgagcactgcagcatgggctttcatctctcaggatacatatctcctgccatcaccgctgttttctgtccatgagctctgaaactgcatgagctgtcttcctctgtgtcttcagtctctcatagagttgccagcccagcagtggttctcagagaagggttcttggatcaggagatggatggatgaaggcatgccctcccacccaagcatatggtgttctagagacctccccccagccctgcccagagccactgtccccctttgtccatcttgctttgtgtttctggagctgacttataaaggctgcatgaggcttcctgttgggctcagctaggggaacacggcaagagaccagagacagggaggagcggaggtcattgctccttccaaattcctcccttcaggttgccatgggacgactacaacctcagccaaagtgagagctcatgccagcgagtcccctccaacagctctccattcctggggtggaataactgctctttcccttcccctttggcctcaggataggggtaactgcatcccactcttcctatcctagccctaggccacaacatgctcccttgagcttcctaacaacctgcccacacctttattaaatgttcctcaaatgactccattttcttccaggactctgtctaatatatacagtatttcattactctctcttcttaaattgcattttttatcatagacaggacaatcagtgtaataatgtatgaaaagctgtaaatgtgttgagaaatgggaaggagagcagaaagggacccactctagtcccttcagccccacgcccacctcccaggatgtgtgtgaagagacgtcagccagcacaaaggccagggctttatcttcagcttctctcatgaacccagtgagaagcaaggctgactcaaggtcagatatttaaaaacagagattttaaattaaatgtgagcatgtaccactaattactctctttgtgtgattaaaatccgggctgctggtgtgatttttgagagcccagagttttccccacggcagcaggctagtaagaggcaaagctggggccagcctgcacagagagctgcattgcccatgacccccggcacctggaagatgaggccttccgtggaccttccattcacggccaggataatgtcaccagctgcaatggccccattctcctcagctggctgccccggaaagagcctcttaatcctcacaagatcacttttgagatggctgcagctctctttctccatctgcacgaaactgaatcccaaaccattggcattcttttttagtttgacttcaaacttaggacctgtagtgtgggatgttgataaaaataaattcttcagtagattacaagtgaaattgaccagtctcaaaatgcagattgtcaagtagatgaattatttcttttacgttcaaataattcctttgctaattttatgacagagtacattatgtatgttatagattagtgctgtccaataaaatataatgtgagctataaatacaaaccacaaatgtcattttgaagttttcaaatagctacattaaaataaaaggaaaaagcaaacaaaaaataaataaaacaatttaaaaagtaaaaggaaacaggttaaatacgctataatcgtacatctaatttaatcccatatatctaaaatattaccacttcaacatgtcatcaatatgaaaaaattattaacgagatattttttattcttcttacgaactaagctttcaaaatccaatacatattttatccatttagattggtcacatttcaagtcctcaataaccacatgtggcaagtggctaccatattgaatagcacaattatagataactcaactatgtttatacataaagatatagctgctaggcatacacaacatgctcttggcatttaataaaacttgtatcacatacattcctattactcctttagaactctagtcatttgtagtatacttgaaactaaattttgaataattagaccatggagaaaattatggccaattctatggacaatgctttagctgccattttgtttacccatgtaggctgaccataagacaaaacagttgcctctgggcaccaaggatgaacagagctggcaacctacatggtctgtccaccaaagaggcctctgggctgccccgctggcatcaatgcacagagggacagagcacagcttgcaaacttcaccagggcaagaatggaagcatgtgaagcaattatgtgaagcaattatgtgaaggtgtgtcacacgaccagttctaccatcgccctaaggcctcctccactctttggagtccatttctcaaaggccccaagggagtgagcaaaggggtgaggacagaggagacttgatttaaacagaagcatgcccctttgccccacccctaccctatggctggcttgagtcttctgcagcaaaatcagaaaatctctatgaagggactaaaacatggctaaggtccaaatcgttcttactgaggaaatcagcgtgttcctggcaaataccaaaatcacaagggaattgcagatgggcagcccatcggaaaacgtgcagttttgtccctctaaatgatcgttcgtttgccttttaaaatgatgctaataacaaggctagattcctgaaccttctctcccaacctgcctagtcattcctcaaataactttgttacaaatgacttggctggactgtgaagccaaatgtatctgaaagtgtatgaccctttcagtcaatttcatcctaaatattcacacaaacattaacattctggcagctgatcaaaggactgaggaaggctgggggcagaaagatgcctagaaatcatttggggaaaatgcatttgtttccagaaacctattccatgagatgggcttccatggcatgaaaaagccgatctcagcatgatcaccatggctcgctttcttttcaggacccagaggaagccttcctgcctttcccttttgacttgacaattcaaaagcggcacacaataacatgacaatagtaacactcaattctctcccctctcaccatctgtcaccgagacacagctcgaaggcctgccaggcaaggctgttaccaaggaaacagccgtgcgttcatctcccatgctgtcattagcagaaggacactgctgtgtactcctggggactcttctctctaagaccagtcttgcaacctagaaggaaaggtgaacaaactcagtttacacttcatatggcaaccaggaggcactcccttgactctgcaaatgcttcttaattttcgaatccttcctataagcagactcatttgaatctctcaactagcctatatattgggatctagacccagatttctcagtgcttattagacaagtgcacctgaaagcaacacatgtacctccacttcacacatgcagtgccacactcatcttcctcccctcactcaccctcacttcccctcctcattcttcctaaaacactcctcccctcgcattggctcaccccaccattaacctgccaagggccacatttggagtggtccagctctcccccatctggtttctaagatgtgaacattccccatcaagaacagctcctcagtgccccctcccctccacctcctctctcactgccagtgacccgctgggccgtggcaagctctggttaccttggctcgctggaccctgtctgcaaccttcttggtccaccccatcatggctgccagtgaattggtctaagacaaaaactgaacatgcaacattcttgatttgaagtctccaatgcttcccatcacctaagacccaaacccatggcaccccaggtctgtaccacctgccctcccctttctttccaatgtgatttcccacatttctccccacaacaccatatacccttgtcgccctaagtgtgattcaagaaccagcagatagacatcacctggaagcttctcagaaatgccaagctcccattcagggcatgtggccctgccttcatcttcctgttgcacctgtcactcagcacctggcccaggatcccagagggacaattcctacctgcttaagctgccaggaggccagccaagtaccctctctacccatgctcattagcaaaggtctaaatatcagaaggtgccaataaattatggctctgttctcaagataggtcaaccaaagtcactaatataagcaaatttcaccagacaccagaaaaacgctttgggaaagaaagcgaaaagtggccagaacattgccccaagcttgctggaagggccttcaggaatccctcctgtctctgttgactttttagttgccaaaagagggtgatgccagctctgtggctcaggacacagaggcagttagaggctcctaacctcaggcagaggactcggcacagtgggataacatcgagtcactgcggggcagggaataaaggggacataaaggatgaatggctctgctcttggcaccctgaattcctacctcattgtgaggaaaagaatcccaggacactctgacccacgccccggtgggtacaacacagggtgagggggaatggcatgaacagggaatggagtggggtcatcccatgcaaacgtagggaggtaagaaggcccatggtcacagggccagcggggctggggcagccagagccaggctagagcagtctcttcactccatcttctccattccgctgtctgattccagaattcaggcaagccaccagtaagtttctaaggctatctatggggggtgagattttttttactcagaaacatctatctgctatctcctgggtttcacatccccatagaaaagtgagggtaagaagaaatggaagagaaaaaaaaaactaacaaagaaaaagtcttgtttcctgcctgcctccctcccacccagaggcgatttcagcttctgatgttgttcaggaaagttccggaaggaggggaagctggtcagcaacagtccactcacctgcccaggacccttcaggcactgcacagcctgcttgtgggtgaggccgcacagaatcactccatccacctgcaggagtcggtcacctgggaaagggatagatgtcatgtcatgacctggtgcttgaggctgcaggaggttcccttccaggaggaccctgcccggcacccctccatgcagcctggagaagtgggaaaggaagctgaggtgccaggtgtccccctggagtcagcaggaatcctgcctctctgagcagtctcactcccttcttctcaggcacatcacagatcagggatataaaagcctttctattattggctcacagaatggttgagccagctctgttcaaccttatccttcctcctgttttcctgtgaaaccgtttttgaaagtattttcaagtcacttagatatttatatctccaggatgtattttttttatttcaaaaaaaggtcagggaggcatggttgacgctggggacaccagaattctaggggaaatggagataagtaagatcctaggttccccttttggctcaattctggcagttttggagaccaataaaaatcacccccttccatcagagaagtgggagctgagcaagggcaaacagaaggctcaggtgtcctccccggatgtgcgagtgagtttaccgaggcccacttgtcctccaagggaagcagtatgttttcccatggaggccaaagagcaacacaagtcttttaagtcttctactatttttctatcacctatgcttcccagtgtgccactgcagaccccccaacctatcaaatgggcagggcagattctatcacctcctttccaggtgagaaaagtatgacctggggaggcaatcatttgcatgagttttcagaatgggagcagggcaaggcctagaggctgcccctcccagtgcagggctctttacaccatggagcacagagttcccaatgaggacccatccccatctctcaccctgtaggatctgcccttccttggcagctggtcttccaggaacaatggatttcacatagataccaccatatggcacactggtgttaatgccaccctgaaaaacacaacaaaaaactcaccacccatctttcctcctccaggaagcctccccaacctccccagctaagggaatccccacctgcccaccactctatcccatgaccttacctccgactggcactgtcttctgtattcacctgtttgtttagattgtattctccactgagcaataagattaggtgttcataagcttaacaatagcaactatgtgagagatctgggcatgtccccagcccaagcactggtacaaggcaggtgctcagcaactgctcacgtgggatgcaccactatctctatataggtagtgaccagcgtaggtggatatggctatgggcctgaaggcttgtgcctggcacgtcttgtgtgctttgatgggccaaaggatatgtgcatttttcattataatagatgttgccagattgcatccctatgtgaatatggatatacttattcacatttctaccagctttgtatgacagtaccatttttctacgttccaccagctgtatttggccaagctggtagacataaagtttaaaattttattttaatttaatttgtattcctgtggcttttcacgggtttgagtgtttttcatgtgtttaatggccatttggatttgagtgagacatttcaagaattatttttgaaattaaatatctgcaaagaaaatccaagtttttgccagccaaaggaaatcatcaacctcttctcagcaaatatatatttgtgaataacccaaaatttagtcagtttttcagatgaaaaatagctatgtttggtgtctgataaggctgttaccccaagccaagaataaatggaccatatttggtatcagcctgttcactccatgtggattcatgagccttattgcttggtttcttacttggtcccttaaaatcatctactgatgacaaattcattgcaggcttagggtccaagaaaacacatatccttgctctaggtacatagcattatcacaggggaaagcaaagaatgccctccattcacatatctcttgaatttcctctgaaaattttcatcagccatagagtgtccttactttggtgggagatgccattctatttcccatcaacagttaaatccaacaatgacattcctgaaatccagacccattccagggtctgaaggtaatggatcacttttttttttttttttttttgagacggagtctcactctgtcgcccaggctggagtgcagtgttgtgatctcggctcactgcaaactccacctcccaggttcacgccattctcctgcctcagcctcccgagtagctgggactacaggtgcccgctatcacatccagctaattttttttttttattttttagtagagatggggtttcaccatgttagccaggatagtctcaatctcctgaccttgcgatccacccgcctcggcctcccaaagttctgggattacagtcatgagccaccgagcccagcctgtaatggatcactttcaatactcagtaataaaagcagcaccttccaacctctgacctctggattttcaccagttttgtgtgtgccattccccaaccccttgggtaaacacagttatatgggtaatctcctttcacaagggtctaccaggcagagctcagaaaccaaatggaaagtgtcagtcctgatggaggcctggccctgggatgtctgagccagaggctccacactgattctatgctggatgacagtggactgccccacccatccttggccagatgacagtggactgcccttcttacctttagcttgtgtccctgaagccccaatgtgcttctctctctctgcagtccagcttgacctcagagtcaggacacatcagccaactctgcccacactgcctcctcatgagtttggagtcccctagtgcatgccctgctcatcctgaggttccccagtacctctgtttgtctctgaactcatcccccagtgcaggcccccattggcttttttatttaccccttacatttgtgcaaactaagcacactgtcagaggttgccatctgggtggaatggccaccaggttctagacggacatcttgttaactgcttttcaagctctcctaaaaactcttacagttacgctgaatccaagtgtcccatcttctttaaccagttccacaaagtagatttcaccagcactgatttctggaggtgatggaggacaagaagaaccagcaccctgccataaacaaacaaacaaaaataaagatgggatgaaggaagatgtcacctcttggctcatactgctctcaggagcaggcagcattgcacctcagaaagatcatgagttttggactgggccagcaggggattcatttccagctttatcaggccttctgcatgtgacctcagacaaagcaggaggaagatgagggagtgatgggctgggctgatgccacttctaggcagagaatgcttgggtcactgttcatgttccgctgtccctctgcctagaagatggggtcttttgtcctatctgccccctttacttagtgctttctaatcaccatgaatgttagaaaattctaacgacacgcaggaaaataaacaagctggaggaagctgaacaacgaagcctcaactgctgaggttgagacctgaagtgagaatctaaagtccaccataccacagaggatcatctggccacaaagttggccaagagacccagaagagcctgcagcatctgggttgcgtcctacagcctgcaccatggtcaacgtggccttagagctcccttgctcccctcaacggcccccagccccaggaaaccaactctcaggtttgccaccaaagaagccccagcatgaaggcctctctgctctgcttcctgccagagaggacctaccagaggaaggcctggggtgaaggtttctgctctggaggccaatctgaatcccagctctgtcccctgctccctgagagagcttgggtgtgctcctttgctctttctgtctcaggtaccccacccataaaaggggttgataataggaatgatctcattgggttaccatggagcttccatgagctaatacatataaagtgctcaggacactgcctggcacacaggtaagtactcaattaatggcagctactatcgttgttcttccactggcctcctgtatccagttcctcatgggatgttctgtccaggtgagcaccatggccaattaggaaggcactgtcattcatggagccctattgcatgccagatccttgtgacagaggtcaagacacactaccccaaaatagggcaccttggcacattggaggaattggagaaacagcacatgagggaaggtttctctgaccttcccctgcccttctcttctgaagcaggccctaaaacctaggaaggattttctaatcttcccccgaagcagggcacaagaccctcaagtgagaatgccctccctatatctggaaaaatggagcatcttatgtgggaagacacagggactgagagaggaatctgaacaagcaggccctgctgagttcctcccaccttacatactcctgctttttgtcttatctcatttctccatgactctccattcttcatcaaatatactcagggagaactgtttcttcaggtcatttccgtaagaaggctcacatgtcacataaaacttatagtaaatacacgtggatgcttttctctcattaatctgtctttagttacaggggtcccagctgatgaagctaagatgagtagaagaaagatacgggttttatccccgacactgggcatagtaccttagtttccacggctgtggacagacatcattatctccatcataaaaagagaaacaaggttgaaagaggtgcaataacctgcctgtttcaaccagcaagttgtcccagcaagaatgagaagggcatacactcagcctgagtaagggaggataggtcatgggagacctgttttcaaaggtcttgccagcctttggagaaaccagtaatatcagttcagcacctggggctagaaacactgggtgctgtgaccacccctgagcctgaagggcgagagaagggagtggtcgatggaccctcataggagctgtgctctttgtagaggggcacaggcaacctgtgtcagcacagggagagagtggaatgaagggtgtgcaactgagactccagcactgccaccctgtcctcactcatcccacaactgcgggctcctgctgaggctttgactgggcagaaccaagcagaacacagcaaggtgactcagtccatgagcaccagctgtgcagggcccagagcagaatggagaggctggggcatgggtctggcggggcctgagaagacaacaccactgggagtccaaagagacggcagaggacagcagagctgggactgaagcacacagccctccatacacctactccagatcccatcttcttcctccatggggtatggtcaagagcaaagccactgagttcccagcttgaggaccaattcaaggacaagaataggaggtgcctgattgcccacgccttgccattggcagcaatcaatttcctcatggtgctattatcacaacaattataattagtgactaaagactccagaggcacccacactgagcctgtgcccagacactgtcctagaactctgccttcttctatgcgtttttctcaacaaccatgccatgcaggcatttgcttctgtatgcaaatgaggaagctgtggctcaaacgggctaagtaacttccatccacctgacatggaaaacagagaacaggaagggcctaggggccaggctgttgggcttcacagtctgttctctttcatccagatctagaaagtaaaccaagggatgattacctttaacggcagaaaggaaagctgatgtctcagcctgggcactaagctctgcaccccagccatgtctagttcttcagtatttctgtcctggtcttgtgtgtgtgacaacaaacttccctggtacccgaagctcaggatgtctgtagaggagaccccagaattggctgtgctattcttttcttcatctgggttatttccaccaacacctataaaaacaagccaagaaaaagtcaacagcttaaaaaggctggtttcttggtggcatctctatgtgggcacagcgttttcctccagtgacagagtgatcgtttatagctgctcgggtacaatatgaatttagctcctcctgaaagatgttacatttagattagagaaagggaagattctacatgggatttagaaacctagatagagcttacgtgacccaactatgaatgcgtaggctcaaaagaagttcataaggccagctatcccttattaagctctagccatgtgatgggcaccttagatatacatataggaagatatggacatcttcccatcttctcagcaaacccaccaggaaggtgtaatcccagttcaaacatgagaaaacagagtcaaagctattaagtgtcctgccccaaatgctacagccagcatgtgggaactgtcttaaacccagcctctcctggacaccccactgagcacatctgcagccaccatgtgatccaaaaaccaatgtatcaggtccttttgggaggcttggtaataaccaaactgcaggcccctgtgagtgaaagctaggccactgattcctgctcaccctgtgtctgactcgtgacctggcatagaacaaagaaaagaacgtgaggttgctgatgtttatacattttgcatgtaattactaccatagaattatacacttaaaaatttttaaatgatgtatgtatatcatattgaaattttaaaaagcaaacaaataggaggtgcctaagcttgactcatgttcattaatttgctgacccctttattatggcagtggttaatatattttagaatttaaaattcacttaaaatatgtgttaaaagacagattgctgtttccttagtttctgattcattcatgctggaatggtacccaagaatttgcatttctaatacatttatgtatgatgtggatgctgttggtctgttgatcacacttaaaaaacttctagactacattatgcctaaaacagttcctctgtctcatcagtgcagttgtttaattgatttgttttttttttctccaagtaaagagattaagttattctaatctaataacatgctaatatagtttggctcagtcaggcaaaatcaatcatacatatgaaatcattaacagctgaaaagaaatagagagagacaaagttgggaagagattaaaagtgagagctgatgtgggattgcctggatgcaactaacatcccagttccatcacctttctcctctgtaacactggaacaggtaatgaacttccctgagatttagattcccttgcctgtaaaggagaataaataacaaaaattcctcatagagtattttgaggattacatgggatactgcttataaagttgctagcaaaatgtctggtacataacaagtcctaataaacagttacagatgaaaaaaagatggacagggaataacattcatgacaaatcaatctgaaaaatgttgatgtaaaaaattctagaactcaggatatcttcacaaagtcggtgtattaaaataaatatggcataaaccctccaatgtgagccttataaaaagaggagatttgcttattatgaaaaagagaaagagtggagggtctatgaggtaattattaatattagttttattaaatattagcacatttcattaagtgtgcagcaacctcaagctggtgttattaactgaacttgggagaacatttgagctcatgaactattcacattgttctaaatctaagtaaaaaagtgataaaagagagagtgcagaagctagttaaaatgtgttttccatatatataaatatacataatatataaataaatatatattatatataaataaacataaataaatttaatatttataaatttaacatttataaatatattatatattatatataaataaatatttataaatttaaaagttataaatatattataattatatataaatatttataaatttaaaattttatataaaaagatataaatatatatgtaaatatataatgtataatatatctaaatataaatatatttaataatatataatatatctaaatataaatatatttaataatatataatatataaaaatgtaaatatatttaataatatataaatagattatatatatataaatgtagctaacagttccaacaatgttcaaataaggcaaaggcccagctgcaaccaatccagttgtttctgtacctcactttccttttgctgtccataaatcttcttccaccacgtggctgcgctacagtctctctaaatctcctgtaattctgggcgctgcctgattctcccatcgttcattgctcaaactactttaaattttatatatatatatattttacacaaagaataggctgagttaaatatacatcttgctgtttgcagtgaccattctggcttatcattacagatgtcttgttttctcctatagaagtaacacactttactacttttcaagacagattgttacactgattctatgattgtcgttaagagaaaaatttcaaccaaattaaatgtaaagtagtatgagcaatgaatgatgggagaatcaggcagcacccagaattacagcacatttagagagactgtagcgcagccacgtggtggaagaagatttacggacagcaaaaggaatgtgaggtacagaaacaactggattggttgcagctgggtctttgccttatttgaacatggttggaactgttagatacatttggccaaaactcagtgattggtacagatgtgggctacagttggtttacaacttcacttgttatagttcacgatgtatagaaaaacctttaggttgaactttaatatgtaaggaggcagctttaggctaaatttgatttaacaatttccctctttgggtcattttctcaatcttgagatattgaccaaaactttagttattgatgttactattaccatggctcttgaaacttactgggaaagagcagaacagtgagtttggcaaagatgggaacaaggaccgagtagagggtatgtccatatgttggaacattctgtttacagaagaaaaacaaaacctggtctgttctagaatctgtttgctatgttttccatgatcaaacgtagtttgattatgttacattcagcacaagcaaccccagttttgtctggtttggtctgttggggcctagtgcatgagctcagtccaaaacaatggcctcccataatttcatttaaaagaatccccttttttttaggtcatgttctcacttaggtgagagtgtgaccaaacttagggccttagcaccactctcagttaccatcattgtggatttctggtctcagcatgtcattcataagttacggtgtcctcatggctgcacatttctttcagctcttgtcattccagttaaagagagaccatttgacatgctagagatgtctgcatgcaaacatttaacacttttaaagagaatatagcacaccagaaagactattattatgactatcagtaggataataccaagagtttggagtgtgctccttacccggggtccccataaaccaaaccacccaaaattaaatagatcaaaggatgagctacatgaagagtctactcacttaactaaagagtctcggccgggcgcggtggctcatgcctgtaatcccagcactttgggaggccgaggcgggcggatcacgaggtcaggagatcgagaccatcccggctaaaacggtgaaaccccgtctctactaaaaatacaaaaaattagccgggcgtagtggcgggcgcctgtagtcccagctacttgggaggctgaggcaggagaatggcgtgaacccgggaggcggagcttgcagtgaggcgagatcccgccactgcactccagcctgggcgacagagcgagactccgtctcaaaaaaaaaaaaaaaaaagagtctcttcattaatcccctacaactaaatctataatatgtgatgttttccccataggccataagtgccagcagctgtacagatacttctgtttagctagtaacttatccagatcaattctattatttagcataactttcacaagagaatttaaagtttattgtgtaaccatagcctttacagtagaatctgctttagagcctatcatgaggaatacatttttaatctttgccgcttttattccaaactatggaaaaaggacctaacaaatgatgcccttttagaagagtgaaagcctcccagcgatgttctccttaacccatgatgtgggttaagaggagtaaatcaatgttctgtttctgactgattatgaggcaatgtacgtaccattaaagtttctcatctacattgggccttcatttttgtctattaaggtataaggttatccatgtataaggctggctgcaaaatccttcacaaataaaagtataccccataaatgcacacaagagaaccctttcacttctattattcatagaagcataagcaagggacaaataatcaaagataagagtctcatgatagtagagaattcttgatccatgatcttgggaaaacctgttcacagtcaaggatgccatcttctggggagaaacccccctggttagcttttctttaaggcttctaatgggtgtacagttccaagagtgtaaagggagccttctcagttgtgagattatgaacccaaggttcaaggtcctgaagttttactgtagtgtgcatgccaatgacagtctttctttgatgttctcagaagatcagtcttcaggttctagtttatgaaggcattgattgtcctcagtgaaccataaaaaccttactttacctggtaaaaatacactgtagtataattatctactgctacaaagatggcagtggcaccccatctggagcagccactgccgtcacatcagctacagaggtgaaacatggtaaagagctggatacaagtgggaaacatgccccttctgagttggtggagttagagcttcctgggaacagttgcagcagcccaagtagtggctgcagatctgggcctcccattccatggagcacacaggacacctgtccttcaagatgcaactacagatgcccaagccacggctgcagagtcaggcatctctacactcttgggggcacaggaaaaaaccccaggcccttgcagacttggaggtatcttctgctcccattgcctggctcctccccactcttgacatctgctctgatcttggagcaaggttgtgggtaggctcaggtgctgttgcagcctggtgggtgtgcacatgcttgaggcagtgctgatacaccagtaccatactgtctctggcccctgcccaggctttgggcactgacaagcatgggagggaagctgaggagatgctgagggcagcttggcactggcctgcaggcatcctttggcacaaatagcctgggtgccatgaatggcagcaggaggcagacaggctcctgcacagaagggggtgggtccttggtgaggcctttccttcaggccaggatgggtgtgaaggctggggtctgggctgccagtcccgtgaaccagagtgtaaacttgtgatgccttttctggggccatccatggcctctcatggaccgatcagtgtgcatttcttcctttctgagacctataaaagccccaggctcagccagaactgagcagacattgggacaaccagctacagagagcagctacccactccagggcctcatctcttctgagagatgcagatattgggatgcccagctgcagaatggaggtgcccactccaggacatcctctgagttattctgtcactcaatatagctcctctttgctcactctccacttgtctatatacctcattcttcctggaggtagcacaagaacttgggacttgccaaatgacaggactaaaaatgctgtaacacaaacaaggttgaaacatgccccttgctcaccatgttgtggatgacaagaagagagaagaaaaaaagagctgtggctctatgggaacccagacctgggagctccccaggccagagctgtgactcccgctatgggaccctgtggttcctggagtctgcaagcttccaggtacaactgtgttcccttgtaacagccatggaagctgcttgtggtgtgtctggtccagccaaagccttatagtgagctagcactcatgctggcacctggagctgcctgtcccagctgcagcagctggtgtgcctaactgtgttaaaatatattgaacaatatgaacttccactcaccaagcctgacttgattgctcagtctaccagtagcagaggacaatattgagcccctgatatggtgacattccctggagtaatcggctggctgcctgggggcaggctgattacatggtatgaatttcatcatggaagtagcagcattttgttcttataggaatagacacttactttgaatacggattgccttccctgcatgcagtgcctcttcccaaactaccataagagacttacgaatgccttatacactatcacagtgtatcacacaccattgcgtgtgatcaaataagtcacttcctagcaatagatgtcagcaatgggcccacgcttatgatccaatggtcttaccatgttccgcatgactctgaagcaattggattgatagaatggtggaatagcctgttaaaaactctgctgcagcaccagctaggtggcaatgtcttgcagaattgggacaaattctccagaaggctgtatatgctctgaatcagcattcaatatatggtgctgtttttaccatagcagaattcatggctccaggaatgaaggagtgtaaatgagagtgacagagttcactattacttacctgtagtgactcagtagcaagatggttgcttcctgttttcatgactttatcatataatatgagatgtactgaatttgtttcatagtatttaagtaatcctaattttacatcatagtatttaagttaggggatatcaagaagagtaaacattactcaatgactttgcttcctctttctgggaagggattagtgcaatttttggtgtatacaggatagttgtatcctgtcaggcagaattatgaccttgctattgtgtttatttgaaaattaaatatggttttaaaagatacatataggtgccacattgacacagaataaacttataatagctagttttatgtgttggcttgactaggccatggagtgctcagatatggaaacaaatactattgagtgtatctgcaaggatgttctagatgagattgatatttaagttcatagagtgagtaaagcagattgttctctctaaagtaggtaggccttatccagtcaattgaagacctgaatagcacaaaacagttgattaagggaggactcctcttgcctggcttcctgagctgggccattggtcttttcttgcttttatattcaaatggaaacatggattttctcgggtattgagcttgccagcctttggactgaagcttacactatcaggtctggttctcatgcctttggactcaaactagaactaaatttcagcttttctgtgtctccagcttgccaattgcagatattgaaacttatcagcctccataatatgtgagccaatttcttgtaatctctctttctctctctctccctctctctctctctctcaatattgagagcagtatacacagctaagatagtcatggaatggacatgatgactctattactcaatgttatctagagaaacatatgatgagcaagaaaggataagaaattggctcacaccatccttatagaggctgagaagtctcaatatctgtagttggcaagctggagacacaggagagattaaatgtagttccagtttgagtccaaaggcatgagaaccaggagagctggtagagtaagattcagtccaaaagctggcaggctcaatacccaaaaaagacaatgtttctatttgaaacattgaaaaggaatcctctcttaatcaactttatttgtgctattcacctcttcaattgattggaaagggctacctacactagagagaacaatctgctttcctcactccatgaatttaaatattaatcttatctagaacatccttgcagatacacttaatatcatttgtcagcatatctgggtacccatagcctagtcaaatcaacacataaaattagctattataagttcatcccctgtcaacctggcagccatgtgtctcctaaaaccatacttaattgtcaattaaagaaaatagcaaggtcataattctgcctgatgtgatacaactatcctgtggcaaccaaaaatgcactaaccccttccctagaagaggaagcaaagtccttgagtggatgagggctgcctactttgaatatacatggatgtgtataaatacacatttttttctgttcctctagataaccttgactaatacaatcatcatgttcattccctgactatcttagctgaaacagagactaccagtcagtactcttattgcccccgatttgtttattgaatgtacttgctaaaatccaaaaaatacaaatttacttattgtctacatcaaatataatgcaatcactatgggagtaagtactttgtatctctttttacatcacagaatagattgcataacataaaagtgatgctcaacaattacttgttaacctagttttgattaaaacattctgtagagttcaaaaggttctatttttgcatatatgttccctttgtttttataaataaataaattatattaacttaaaaataatggatataatggctttgaaaattctgagactcaccagatggcaaatgatgctgaaatgaataaatagctttcaagcaaagatagaatccagggcactgccaggaaagtatggtccaaaattgtagccaaaaagataactgtaaaattttccatatgttgcaggaagatcaaaggttgtgctttggaatgccatttagttagacatacggtcctctaaaatataaagtatatgatatacagataactcaatcgaacaatggaacctgcaggaagctcacagcattgctctgcagcctcctcaacaaaagttcaagaaagagaagggcatgtttctgaaagtattactgagttaccctttgtgtatgagtgaatctcagtaagattcacagtaaacctacaaaaatttgaaggtaaattacatatgtaaaaatattgataatttaaactgaataagccagattcattttaaagtgggccacccaagtttctttaagcagatagcaggctgagtaaactactcagagttaaatatgttctaacttttatgaaaaagtaggctatttcaaaggataggactgagaccagacggtggaatcaagaaatagccattgattggtaggaataggattaaattcccctcaaaaaaaaagaaaaaattaacattttcccagctagatttcagaactctcattgactgctgacttctgtatgtctccctttttcctctattaagtccgagtgtctatgatgattattctatgcctgtctcatcattttatgatagatgtgtgaaagataggtaagttgtttctttagtttcaaaggtcttcaaatcaagacaaactgtactcaaggagttgtatttgcagctagacctgatttaaatgacaagattctagacttcaaactaatgctgtgatgagatgaagctttggtagacttaggatacaattagtgaggtgtgtgcattacttggagccagagagcagtctacagtaaccggcctctaagaaggaccccaatggacattacctccaggtattcatgcactggtatagttgcctcccgcagtgtaccagggttcatctatatgaccagtagaatatgccagtagtgatggtatgtcatttctaagatgatactatttggcactcaagggttagccttctgggaaacatagagtttgggattttaaatttagaaactgaagcaacttttattctggtagttacatgctctcattactgcttctctctatatatttctaataataattaatttaattaaatatcttcttcttctcaccatacaattttttcatattttactattggtaatgattttaactactacagatgtggtctgtatctatctgcctatttatctgtgtctctacaagtgcataaatgtgtgtgtggtgtgtggaggggagtgtatgtatatgtgtgcttataagttcatggatgaattacaaagctttcatatgtgcatttcagtttactcagaagttagcaaatttatttttggacattttaacctctgtattactatgaaaagatccacatttccattttcatgtaatctctttctttctccctctgtcacacacacacacacacacatacacacacacacacacaccccccacactccaaacaattcttcatttgtgtagatttgtgtattaccctcttcttggttttgtgtctctaaattatttacttaaatattaagttagttaatttaattgtgttccccctctataatttccatatacggtttacctttgaaccatataggtttgaactgcatgggttcacagatacatggattttcttctgcctctgccatccctgagacagcaagatcaatccctcctcttcttgtgcctcagcctactcaacatgaagatgatgaggatgaagacctttatgatgatccgtttccactcagtgaatagtgaagatcttgtaattctcttaataacattttctctcactttctttattgtgagaatgcagtgtataatacatataacatgcatgacatatgttaattgtttatgttattggaaaggcttctgatcaacagtaggctattattatattaccagcagttaaagtcaaaagtgatacagtgatttttgacttcatagaggtcagcaccctaaccactgtgttgttcaagggttaactgaaaacgcactggattgcatgagcataagataataatgagaccttaactactttccagctgaggtaggggaatttaaattctgcataatatctgctgtcaatagatttgcccagtaaagttttgtatcaaataagttctaagtcttatttcacatttttatctcagtttctaaatctgccattattacattggatttaggagcaaaatccattataaaaaacctgttctaacaagaagactgttttttggtagtctcttaaacttcatattgggtgaagattatgctccttgaggataagattcatactgtaacaattttctatatcctccacaatgttttgcagattcaataactatttaatgaattaagttaaatttacctatactcttacaagtcttactctcataaataaccttctaatccgcaattcctctaaaacatacaaaaaattgccaatataaaaaagcaagaaagaaggtgttaaccattttgtcattcaaaatatgactcattctttcttatacaactacctttgtcagcattcttgccattggactgtctagcctttgacactgttatatcatggcttgtcgttagagaaggtaaagtttggaaaaaagaagcagttacgtaaagcaatgttagaaaatccttgagtttcccttagaattttgtgtcttctacgtgttttctatttcacatagattaagtttgcagagttgtgtcataatttcatgagtgtatctgtcaaagagccctttgaaggcctatttaatccaactaagaccattttttcttgttttaataccattaatcttgttctctctttgataactgagggaaaagagaaagacattccatataatacatcagatgcctaagtgctttggatagtcataagccttttctcctatagcttcctaattagaaatgcctgctctgcggagttttcttaagttttccaacttgctccttccattttataatagtctattgaggaagactattatcaaataaaaatcagaatgatcactggacacctattttagccttgggatttatatcacaattccctaagacttcatatttccagaaaagaaattcaaactaaagctcacaattactattattatggtaatcctgataagatgtacattttaactaaaagaagttcccactattttttttctttctacttttcaataatccttgggaccttagtaggagtgtgcaatagtcttgtggtgtatttttagtttaaaagtctatctgattaccacttggtagatattgtccaaactcacttttgaatccaagtgtttttacccttatataatttttttaaaagagtatttgcttgtttctattatactataactattggagctactaggaggccttttaaatttcaacaacaaataggcagaatggagactaactgaagggttgatgggcttaaagaaaataaataacctaacaaaggctaatggcaaaaccaacattagaaaccaagtcactttacttgggattagtggataccaaaatgtgctttctcggaagcagcactttacaaggaaacatgaaaatccacctttgttgtccttcagctaaagggaataaaatcgtgtactttctgtaattttaaccttgttataacagatgctacagaaactcaagtggaactctgactgccttgagagctgaataaaatgcatcctaccatccattgctgctgcatcaaggtattaaaaagagagacagaaggaagaggcgagagaggcacaagttcaacagtgtgagggacttggacacaatgggagggagaaagaaataaatgtctaaatgtcatggaaagaacagacaatgaaggcatatgtaagaggcctgctaaagctatgggacctcagaagcctatttgtaagaactacaatttagaataaggaacttgcaatacaatgcctgaccttcatttccttacgtgcctcaatcttgtcaaaacctttgattgatttttgtatgaacatgaattactgctacaatactcagttgaactacatgaatttctcaaagcagtaatacagtgctatagcgtagcttaacattgtttaagtaatatggtttgcttatatttaagtcatttctaagggacccatgcaaacacagtcaggagatctatttctgatgtatttccaaggctaaaaacaaaaaatgctgttaatgcataaacagtcaaaaagctacgcattgtggttttacagggacttctatttctaaagatgatggttgcatgagggcctctgcctttataagggaaatgtgtagattttaactagctctgtattataatgtttgtgttttgaaaaagaaaagcatgtttctgcactaaaaaataaattcctaatcaaacctttaaagttaacatttagaacagggacagaaatttctattgtttcctaagtgttttgttgctgttgctgtttagatttaaatcattttttagaagttttactgaggcataattgatataaaaaattgtacacctttaatatattcacttggatgagtttggacatgtgtgcatacaccaataccatcatcacaaccaaggtactgaacatacttattcacctccaaaaattttcttttgttcttttttaatggtggtagtatatttttaagaattcagcctttgagcagggtatgaaggaccttcaacaacaaatgcaaaagtaaatgagctaagttcatataaagggttagctctcagtgagatattcaagttatgatcatatcctcaagaggcttgtaaactgactgtgggtttccagtttggttattcacagataggccttcatttgctcattcacctattcattcatatagccactcattcattctcaagaagaggtatttgtccatatctcaccatgtggatgagcagatggtcagttctcacttcttttgccattaagtgtgctcaccgttgagctccaggatggtattttctctcactttgcgtcattaccaaagtggctatcaagattccctcccctaccttctttttcttttttcaatgtttaagagctggagttaatttcttgactcctttggtaacacatgccgatatataccactcaaggcctgttggattaaactgttaaatttgtcatctagctaatgttttctcagaaccagacaaattaaacagagtcaattgttgaaattatttcaaaagataaacaatcatagaatggaaataaactacagaaagtagggaacaggagtaactaagtctcctagaaaacatttgcagcagatgttaagtatccagtctcgttgttataaatgaatttcaaagaatctcatgaggagcagctttacaaaattttactgcactaacaaatggcagccaacatctgtagtaaacacaaaatactgtaccatcctttgtatctccttaaattaagccaatttctgcttacacagaaaatctgtctgtggaaaacactgcttagaatttgaaagcacattaatctggaagccacaacagaagtgtgcttcagaaaacttcttaatgtttttcttgtgagttattctctttacgcttttcacattacaatattaccaagttatcataatgtattttctgcactcccagagcaagataagactctagttgttgctgggaactatacattgtctaaatatgggttcacattctctcacagtgattctggaatcatacacacaaatgagatcactgctgtcacatcactggaattaagacaacctctctactcactggccatgtaaatatagatacagtactcaaatcctctgaggcttagctaattattggttgatttggtctacacttaccacattaactatttgaaaagattcattgatataacatgtactaagaacagttcctgactcataatcattattaaggcaatatttaccaatatgtgacattaaaatagatactactattagataataattcatactatacattcaatatttaagcaacagaattataattttgtgaagtaaattttgtactcaaatagaaaatctaattctataattattttctgcaatattgggtcatagaaccaacaaagaatatgtgactagcttagacgtatgtatttacttatgtgattagtaataaaattcttcactcattcctaggtttgaatcccagatgctctgtgtagcagctgtatagtcttagacgagttgcttaatctgtctgtacctcgatttcctcatttgtactccaattttcttatgtggtaaatataaaattacttaactcagagctatgaggtcagttttatttgagagaatccagaaaaaaaaaaaacttaacacacatttcctaccattcggcatgcataatacgtactcaaggaaattttagatctctgtacatgattaatatattaaatcctcaaaccgactataaggtctgaaaatgcatgtctttatgtcactgtacctctcattgcacttggcacagtgttgtgaatatatttgtcatttgtatgttctttctaccatacaattctgccactccaattagcatattgtgttggaaaacaattgagtgcttgccttatgttttactaaatttatatggaactacgttgacacttccttgcccttaagatgctgggactcactggttgctttctagttctcaggagtctctatgtgactctgtcctttacacttgccctgcaacatcaccctcagccctagacaaagccaacatcatttttaaaaacctgcaaatatgtctgcaattcactgtatgaatattctcattctatcaaaaccctgacctcactaactcaatggagcaatataggatgataaagtagtttatatgaaagtcatagaaagtttgctttgtttattcacccaaaggtatgtttttaaaggatgaggcttttatctgaaacaaataaaattataatttgaaatttcaaataatgtgactaatagattatgaattcatttccaaatatagaaataattaaaatacttgggggtatagaaaaagtgagtgctgtatctattcttttattatattaattttaccctagctgccagaatttagtacttttaacatcaactgagagatttaaggctattgtaattttcctattttgattttcctcttctatttataactcaaagtaatttgataatatacactgtgatgtgtccccatgtatcaaacatttaaaaaatatatttggaaccaaagcaaagatacatattttttttaatttaattttttttttttttgagatgtcacccaggctggagcgcagtggtgcaatctctgctcactgcaagctccccctcctgggctcacgccattctcctgcctcagcctcccaagtagctgggactacaggcgcacgccgccatgcctggctaattttttgtatttttggtagagacggggtttcaccgtgttagccaggatggtttcaatctcctgaccttgtgatccgcccgcctcggcctcccaaagtgctgggattacaggcgtgagccaccgcgcctggcgcaaagatatgttttactaataccacagaggtataatctgctgctatttcttgatcagaagtaaacaagtgtcttcacagcagttgatctaattttcttccccattcattcaatggtattttttgattattatagaatatattgaattagataatgataagtcctttttctttttttttcagaaatggcttctctctgttactgaggctggattgcagtggcattatctcgactcactgcagcctctgcctcctgggctcaagaaatccttcgacctcagcctcccgagtagctgggactacaggtgagcaccaccatgtccacctatataatttttgtatttttttttttttttttttgtagagacagggtttcactgtgttgcctaggttggtctcaatctcctgggttcacaccatcctcctccctcatcatcccaaaattctgggattacaggtgtaagccactgcacccagctgagaaggctttttattataggttgttcttattgttttatttagttggttttcaaggtaagtttgacatataaggtggtataatgtttaaaggtcaagttatagagatagctagattgaagttcaaatccagagccaagttacttagactctctaaggacttgttttttcccttataaaattaaaataaagtggatagccacttcataggtttgtaataagaattaatatgatcatgatgtcacagagttgcaaagagatactgaaacttggctctgccaaaaaatattagctattgccattatgattgttctccttaatacctaaggcatttgctgacaatcaggttactcatcatgtccttccaggaaaaaaactttaagaatgttgaaaacttaggaactacttttaaaatttaattttcagacctgacataacacagctgaggaagagaggtggtagctgattggggatagatgtagagatcattaatggtataagagtgtgagaatgtgaagcaggataggatatgatattactcatacagatcacaaatacatgtcaaaattatatttatcattcatttaagtaaaattcaacattgttttcttcaaagaagaaattgcgcatttcactctacctatttaactctggaaaattttacaaactgagcatgccattttttagtatgaattcctttatttcagctgccctgctaactttgcatgatgagcagaaaaaaatgaaacagaatggttagttctggaatatgaaaaagtatccaagaagaggagtagtcttgagaagtagggaacaggatgaagtcactaggggacagaagggtaggagggagtgggaccagacaaacactgagctctgcatgcacacgtaacagtctaaaatagtcatccagcacgcagactctaggtcaagataaccaagatgaattgcaacttctccacaagcaacatgactttgggtaaggtatttaacttttctgagtcttagtttcttcaactgataaataaaaatgatggtcatatctacttcataaaattgtgataactgattaatacatgtaatgaatagtgtttggcatttagcttaataataagacatttcattaaaatattagctacttttgttagctagcaactctcaattttgcctaaagctgaccccatatctagggttaggttttgaaagaagttcatcaccatcagaactaggtctggaaattataaaggaaagcttaaaaaaaaaaccagaaatatgtgcaacacctatttacaaagaatccactgggaaacccccattgagcccaggtagatggcacatgtcccctttgggcatgtaactcagttccctgagggtcagtatattgtctttgtttcaaaggtcccaaggcaaactttttaataattgtgatcccactcaatagtcatgttcacttactttgtgggtacatttgtggcatattttaaaatgtgaagttgagtgcatttcacttaaaaaccaaaggcatgtaatgacaacatgctatagaggaaaaattattgatttgtgtaaataggcagatcttgtttgtattctagctccatcacttactaattttgtgatatgggcaatttatatcctatctgagcctgtgtttcctctacaatatgagataatttctactttgaagtactgttatgagggttaaatataaattactttctggtttatgatgttggtatatactatttccatgcatgatagttatttttatgaataagattttaacagtaagccatagaaaaatacaatgtaagactgattcttagaatctatcaaaacaggttgtaaaaatgacttaaacatctagcatggcagtgactaacattttgaaaagcttaatttttccattgagaactgtagcccaacacagtgtctgtgcctcagtgttcctcttatcaggaaggataatatctgtgatgcatggactaactctaatgaaaatttttattcttaagacacaagatatttcccagcacagtacataaggtctttgtgctcatgtcagcattggagataaatttctgggaaagaagtagagaaaccgctcatttctatagacatcaaaacaccaaagtaaaagtgaaaataaaggtacgctgcagacttttttttaaatgcctaaactaaaaagtatacctatcaggaaacatccaactcacaaattgctttaaatatgtttttaaaacagtgtgcttgttttataaccacagattcatgctatttatctgatattcccaggtggttgctttgtggggctcagtgccatccttggagcaataaaaagcatttcttctacaccagtaaaaaactggctacttctcacataaaccttggagggcttccctcagtgggcttagtgatcagcaaatcatgtcaaataacccttttggttatttttgacataatagtgttcctagcaggcagtactcaagaattcccagattcttagctttaaattcaatatactctcttgtattaaaagtcaagctatttatccacagtagttcttaggtccacgtttcattttacacatatatgtggatgtaacagctttttccttagaactttttaaaaaaatggaattcagtaaaagtcctatatttgtattttctatgtgccaagaacagataaccatcattaatgtgagccaaatttgaattgaggagctgaaattaggaggaattgaaaaacacctgaaataaatcttcaagtaatgaaggggaaagtttactttagaattagtgtatcaaaaatgagaaaattggctgggtgcagtggctcacgcctgtaatcccagctctttgggaggctgaggcatgtagatcacctgaggtcaggagtttgagacttgcctggccaacatggtgaaaccctgtctctactaaaaatacaaaaattagccgggcatgatggcacatgcctgtggtcccagctacccgggaggctgaggcaggagaattgcttgaaccacggaggcagaggttgcagtgagccgagatcacgccactgcactccaacctgggtgacagagtgagactccttaaaaataaataaataaataataaataaacaaataatttaaaaaagtcattgctttatttttaaaaaagtaatagtttcaaaatgtatacatgtaaaatctaactgggaatactttgtacctacttgtagcccaagattaagtttattctcaattactaggaggtttgcacaatagagtacatatttaatctgtatgactaaaagcctcattgtcaatgtgactgtgtcatcattatcacatttgtgaatctcctgattataactttcacagatggtctatctacagggttctgggataagaaacttgctgtctgtctacagaggaagctgttttcacttccagatagttctgaatatttgaaagtacttgctgattcagagtcaaattatgtcttgctgtaacatccacaatttctgaacttacatttgagataaaccaagattagactaaaccatgccttcaagtgacagactctcaaaaatgtgatgtattttttttcaaaaaaaactgcacgtccaggatactctacctggagaaaaacgtagctctcattaaccttgtccagacattaaacttataagagaaaatcattattttccttgtagccaaattattccgctaaattgtttttaggcaggattaataaacctttactgtaaagggaaagaggctaagatcttaggttttgtgggccatataatctctatacaactattcaactctgctgttgcagtgagaaagcatttatagacgatacacaaatgaatgagtgtgtccatgctgcaataaaactttatttacaaaaccagtctattggctggatatggcttgcaggccatactttgccaacccttggtttacagcctggctagctaaacactgcttgttgtagtaaaatcttgctttttaaaacatatgtctctcatcctagcattgtcattacatgtgtgtggtttattgttgaatatgtaatatttaaggatctttcctatttagttttattgactaaaagctgtttcataattataatacacagacatctatataggtttttattttatcattcaacctattagctaatccttagagttgtttcaattttcatgtgtttgacagatgaacatgtctaaaacactgatgaaaatgttaccagaatataaacaaaaatgaatttttccggttaaaaccattttacttgttagtaatatgtaactattaaccattaaataatttaccaaattattccattacgtaatccatattgctccttcttgtccacaagaatatagtaaggtacattatcaaatacatacctctgactttagtgggcatttaatgtattattagaggatcccaatatctgtctttcttaagaaaattaaactcatccctagtgattatacactttcttcatctaacactataatattaataacatttgaaaaaataatgtctaataattaacactagatttagagtatttttagacaattttctaaaattatctgaaaaatttgaccagaatcattgtaaaattcacatctgagcttatgaaagcccactttattccactctaaaagaacaaaattttgtacttttaattttatcttttaaaatgttttaacataaaggtagtgggagacgttactaaaggaagcttaggtagtaacgtatttgtcgtctcagttaacacaaagaccatagatggggcagatctgcaggatgcaaaaactttcctttttctcacctcatagtagtcatatggctactgcaattctctggtttcatgtgcttacaaaatgtcctttagttaaaaataaaaagaaagagaaagagaaagacaaagaaagaaaaagaaagagaaagaagaagaaaagagaaaaaataatttcttcatgtgtctatttaaattaacaaagacgtgaattgtcccagacctccctgtgatgattaatttcatgtgtcagttttactgggctaagggttgcccacatggctgataaaacattatttctgagtatgtctgtgtttccagagaaattagcatttgaataggtagactgagtgaagaggatcatcctcaccaatatctatgggcatccttcaatctcttcagagcccaaataaaacaaaaaggcagaggaagggtgaatttaatctgtcttcttgagctgggacatccatcttctcttatcctccaatattggaacacctggtctatgttggtaggagtgtaaattagttcatcataaccttgttggcactagggaccagtttcatggaagacagttttttcatggaccgtggtgtagggaagatggttttgggatgattcaagcacactacatttatttatttatttatattattattatttttgagatgaaatctcactcttgtcacccaggctggagtgcagtggcgcaatctaggctcactgcaatctccacctcccaggttcaagcaattctcctgcctcagcctcccaagtaactgggattacaggcacctgccaccacacctggctaagttttgtattttcagtagagatggggtttcaccacgttggctaggccggtctcaaactcctgacctcaggtgatccacctgccttggtcttccaaagtgctgggattacaagtgtgagcaaccatgcccggcacaggcacattacatttattgtgcactttatttctattattattacattgtaatatataataattatacacctcaccataatgtagaatcagtgggaaccctgagcttgtttttctgcaactagaggtcccatctgggaatgatgggagacagtgacagatgcacacactgcagggggattgcattagatcatcagacatcagattctcataaggagcgtgcagcctagacccttcacatgttcagttcacattaagattggtgctcctatgagaatctaataccaccattgatctgacagcaggcaaagctcaggcagtaatgcaagtgatggggaatagctgtaaattcagatcaagcttcgcttgcttactcactgctcctactgctgtgtggcccagttcctcaccaggccatggacctagtccatggcccacagggttggggaccccgatctaatgtgacaactctggaaatcagattctataccccctatttgttgttgctgttgttgctgctgttattgttgttcagtgtctaatgagctttctgaaataattttgtagtctgggactactcttcaacactcagccaggcagtttacatctctgccttagccttcacttcctgcttgcccagagcctcaaggccagtcagaggtgagagctttgagccttcccaggtctttactgaacatgtacgcaggcctacacttgggagtagcctcatagatttctaggaatcattctgttggaattttcaaagcccttatggacatctcattctcctgttttacttttaaagctttttagttagcctattgtctgcccaaaatgttatctacaacctcatacaggcaccaacttgaataacggcctttaaatgtttttgacaaatgccattaaggaaaaggctttttcgttaagtgagctcttaggacagaaaaagacatcctggcagtgggatgtttctgaaaaccaccagccaagtcaaatgacagttctctgggaatgaggctttgaaggaaatccagccccattctgtctttccagtggctgccaggctattggtcttcactgtaattatgggctgttaattttcaaggctgcagtggagccagcgaggagaggatgagaatagaatagggcaagttaaaaataccatactgcttgctgttcttaatgagatttttcattttatttatttgtgtgtgtgtatatatgtacacacatacacacacacacacacacacacacacacacacagtgaatggaaaataaatcttggggccccaaaatcactaagctaaagggaaaagtcaagctggaaaagggttagggcaaacctgcctccaattctattcaaagtcatccctccattcactgagataaatgcatatcggattgcctcctttggaaaggctaatcagaaactcagaagaatgccacttgtctctcacctacctgtgacctggcagccttctcactgcttgtgctgtcccacctttcttggcaaaaccaatgtatatcttccatatattgattgatgtctcatgtctccctaaaatgtataaaaccaagctgtgccctgactaccttgggcacgtgtcatcaggacctcctgaggctgtgtcacaggtgtgcctcctcaaccttggcaaaataaacttcctaaattaactgagacccttctcagatattcaaggctcacattttggcaaccatgaagggattctgggtggaggctcccctgacctttgacaaatctcctatcagtgctcggtaccagcttgaactatctttatggctcaaaccaatagaacaatttgccgagacaggcctggaagcaccccctccagagaatcactgatctttcaaaacttggtcaagatctaaagtttattttgcagtacaactccttttttttggagttttactatcttccaacgcaagaaaggcaagtttttcctgctttgatgacgatgaaatgcaggtaactcctttatggagtttgagcttgcttccaacggggaagacaaatgtgagtttcttccttcttctagtaagggaggagaccacccctcatatcgtcttatgcccaatttttgcctccaaagaaagaagtaaaaactaaaaggcagaaatgaaatccacaggcagacagcctggcgccgcaccctgggcttggtagttaaagatcgacccctgacctaatcggttatgttatctatagattacaggcattgtatagaaatgcactgtgaaaatccctatcctgttttgttccaatctaattactggtgcatgcagcccccagtcacataccccctgcttgctcaatcaatcatgaccctctcacacgcacctcttagagttgtgagcccttaaaagggacaagaattgctcacttggggagctcggctcttgagacaggagtcttgccgatgcccccggccaaataaaccccttccttctttaattcggtgtctgaggagttttgtctgcagctcgtcctgctacactaggatggtaaagagcagtcttcagcctgagacccatcccttacctaaggatgggtaactaaactgggggttgtcttggctaaagttaagattaacaaccagctggttgtaatttctctttaccattagagcactcagtagttggataagttgtgccatctttgttttgcttaattgtttttgttgttgttgtttgtttgtttctgtttttgttgttgtttcagtctttttgccattgggattgatcaactctatccgacttgatcaaatccaaaggaaacttccaaattatggggaacaagacctctgaagtggctaaatttccacactgtggtgggggagaaaaacagccaaaaaaggggaaaaaaaaaaacagggaagattttttactttgactacttaaggggctttatttacataacaaggccacctttttgctagccaggccaaactgaaagagcaatggctgtcactccatactgcagttccatagctaagggctctggcttctttttttccaccacgacagcttgggtgtggttcctaaatcaagccatttttggtttgatacttggtacttctgaaatagcagcaatttgttctagctgaattatggtaatgagattttaaaagatttttttaaaggagctcaatgattaaaagtcagcttaactaaaagctaacatccaagatgtgtgtgtgtatgtgtttgtgcatgtgtgtgtgtgtgtgtgtgtatgtgtgtgtgtttgtattgaaaaggccttcacatatttttttttttctcctaggaccttgtctctctttttttttttttagttaaagatttttttttctcagttgactgagttctgttttttgttttgttttgttttgttttatttacttctgctgcctctcctttctcttgcaccctctgctgcttgagggacctaaactattatagtttataatagcctggctttccttcaagaaagcagagaaggcaccagactcctttttggggagaaacctgtttttccttatgaaaccccaagagtgtaagcagataagttcatctcagctcttaaattgcctgcttttgtattgtgttacctgacttattgactaaaagagttgttgcaccaaagcctcctctggtttttaaggaagagtgtagtttacacattggaagtgtcttcgtttaaaaaaaaattttaagtgcactgaaaaagcatcacatggtctagcctcataataattctcccttttgggagattcaggattcagtgtgggctctgcccagagctcagagatctagtcaaaagacaggtatttcctacataaataaaattggtctcttcatataatcctatgacagatttctttttttttttttttctgagacagagttttcgctcttgttgcccaggctggagtgcagtggcgcagtttcggctcactgcaacctccacctcccgggttcaagtgattcttctgccttagtctcctgagtagctgggactacaggcgcccaccaccacacctggctaatttttgtatttttagtagagacggggtttcaccatgttgggcaggatggtcttgatctcctgaccccaagatccacctgcctcggcctcccaaagtgctgggattacaggcatgagccaccgtgcccggctatcctatgatagatatctgtaactttatgtttgatttggcatccctcttttgttttgttttgttttgtttgagacggaggctctctctgtcacccagcctggagtgcagtgacacaatctcggctcactgaaacctctgcctcccaggttcaagcgattctcccacctcagcctcccaagtagctggaattacaggcatatgccaccacacctggctaatttttgtatttttagtagaaacgggttttcaccatgttggccagggtggtctcgaactcctgacctcagatgatctgcccgcctcgacctcctaaagtgctgggattacaggtctgagccactgcccctggtgtagtacatggttttactgcatgtgactagtttacatgcaactagccatgcaagttcagtaacccaaggcggtctataccctgttcaacaagaaccatctactaatgacacttctggaagtctgggcaatgtcaacttgctgtaaaagttcccaaatgctctcaattatcatatgataacaaaggtctcaaatcagtaaattttgagtggccctttactaggaataatcttgaataagctagtactgccctccacaaccacaattaaaaatatatcggtattggttttctcttcagttcaagaatcatgtaaatatgtaatgtagaaaatgaggatttcccatattcccacagaatcacaaagatgatcactggtaatatgcgtgctacatatatgataccaggtttattctactctttttttttttttttttttttttgagacagagtctcactctgtcgctcaggctaaagtccagtgctacgatctcagctcactgcatcctctgcctcctaggttcaagcaactctcccacctcagcctcccaagtggccggaattacaggcacctgccaccatgcccacccagctaatttttttatatttttagtagagacgaggtttcactaagtagaccaagttggtcttgaactcctgacctctggtgatccacccacctcggcctcccaaaatgctgggattacaagcatgagccaccatgcctggccatttttttgtacttttatacaattatatgcttgctttataaaaatgaacttattctacatatatatgttattacattattaggacatgttcccaaatgacatattacattttcatcattcttttttaaaatattttttcgtgagacagtgtcttgctctgttgcccaggctggagtgcagtggcctaatcacaggtcactgcagcctgaaactcctgggttcaagggatcctcctctctcggcctcctgagtagcccagctaagtttaaaaaaaatttttttttggcctggcatggtggctcacgcccataatctcagcactttggaaggccaaggcgggcagatcacttggggtcaggagtttgagaccatcctggccaacatggtgaaacaccgtctctactaaaaatacaaaaattagctgggcgtggtggcaggtgcctgtaatcccagttacttgagaggctgaggcaggagaatcgtttgagcccaggaggcggagggtgcagtgagtcgagatcatgccactgcactctagcctgggtgacagagcaagaccctgtctcaaaaataaataaataaataattaaatatatatatatatatatatgtatatttggagagacaggtctcactatgttgcccaagctggttttgaactcctggactcaagcaatcttcccatctgggttcccaaagtgttgggattacaggtgtgagccaccatgcccagacattttcatcatcctttttttttgagacggagttttgctcttgttgcccaggctggagtgcaatgtcacgatcccggctcactgcaacatccacctcccaggttcaagtgactctcctgcctcagcctcctgagtagctgggattacaggcatgagccatcacgcccagctaattttgtatttttagaggacacagggtttctccactgtttttactagaccttgatcacatcaaaaagattgtgtctcttccatttattgtgcagcttgtacacaattgacacaatgaggagctcagcaaaggacgcagagtgacagcatcctcccttcagtggaatggccatgtctagacacctcttaatcactcccgagaagtagggatgggttcggtgtatgagaataagaaacggagcctccagggttgagacaatttgcccaaaacacacctcttgtgggaagtacagttgcgatcccccaggtctcttgggcttgcaggttcctgctctcccgtgggcccccaggagatgttggctgccaagaggaggaggaatcctcctgggcagaggttaacttttgccactccaggatttgcccaccctggggtccctgccaggaatgttcccccagcaccaccctccccatgccgcctcctaactggctgtgtccttcccaccattcagcaaacacatcctacgtccaggaccagccccttcatctcaggaaggctgccatgggactcccagaacccccatggctcctggagccctgagggaatcacatcttgggtggggagtgatttgttttctcatccagtgcaaccttggaggtaacagtcaagaatgtcctgtgatgcgaagcacttattgtcctgacctctggtccagtgcccttcgctctaagcacatagcatccccaggctgttcctggaggcgtgggctggggtttgtagggactagctggaccagctgggccaggggaggcagccatgcccggggcacatagccactgtccagagctgcccccagagctgggagccatcttgcacatggtgctgtgagatgccctccagagaggaagatggaagctgtctccgtgccccgggactgatgaagggcccattccaggcctttgggcacccgggctcgctacccttctgggagccctgtcctgtgggccaggacaaaggtgccctcactggtggcattctcagaagctcagccgctccccacacatgcacataggggcgtgcccacaccaagccacgtgtgggtgtctggggacaatgagtcttgggggagggggtgggtcccttccagaagggtctggccaaagtccagttatgaaggtgagctgagatgggctccctcaaaggagccatagtgtggggagccccgggcagagcccagagagaaatgccagccccgagaccgagacacgctccaaggagtgctgccaagagcagtagacacagccgctgaggcccacggggcacagtgaggctgtgggagagggtggcccctctgtggccatttccctgcctgtgctcacatcccctcctcaggcctgtctcaccagctcttgcagcccatgacccacattctgtctgactctccttcctctcctggctacagggatccccagtgcccctcaccattccttctggtctctcctctgcctcccggaactgttccccaggaccctctcctgggccagcccttcctgcccctccacatcagtggttccgaaccccggatgcctttgggatcagctgggtacactttaaatccttccagcccagagccctcaggcccaagtcacccccgccagctcctgtgggaccccttggatcagccaaccattttatcatcatccatcatgtcccctgtcaccaagggcctctggcatgttctgttgtccccatgcccaccctggcacccctcacccaccaacctgtgcccacgtcctgccttgagcctgtttcccctcctgagtggtatttcctcactccaggtgggcactggggcagctggcagacatggctgtgagcttctgtcccatccagagggaccctcccttccagattacccagtcaagcttgaccccatggtgtcaccgagacggaccaaaagagggtattgaagccacgcagtcccccgagccccactgagctgcaccagctttggagccggagagagcctgggagactgagcactgagtgctaggtcccttcttcccactcttgagggagaaatcagtgtaaccttcccatcctcccactcttgagggccctggggggacacagggcacaaggagggtggcagaagaggtgtgtgcctaggtgcttggcacctagccggggttcatttctgtcctctcaacttggcctcccaaagtgctgggattacaggcatgagatactgtacctggtcttattttttcttttcttaagatacagggtctcaccatctggcccaggctggactcaaactgctgagctcaagtaattcccccacctcagcctccgaagtagctaggactaaaggcatgaaaccaccatgcttggcttgtccaatttcattctacacactttctcggtatttaaacagctgctgttgctcttcattctgtagctctacatcagattcatgctctagtcctgtatatccaaatgatgactagaggctgccggctctgctctttcaaaggcacaatgagcgtagtccatctacaaaactctcccttttccaatccagctttccctcctgcatcacctatctctctacatctggaaccatcggcagctgccttcataaggcacctcggtctggcattcggaaaaccaccctgtcttgccagagcctcttggtcttgggtagcaaaagctgtatgcaatctaaatcaagctttcaatcatgagaaatcacattccttcttttccctttgtaatatactcatgtgttttttttttcctttctcaataagcaaattgtaccaccatcttattctgagatgctcctttttaaaagctgtagatcacattaatggaagtgtttactgctgggaatattttccacgtgcaatgatctgtaaccctctttttcttttttttttgagaccgagtctcgctctgttgcccaggccggagtgcagtgacacaatctctgctcactgcaagctttgcctcctgagttcatgccattctcctgcctcagcctcccaagtagctgggactacaggtgcccgccaccacgcccagctaattttttttttttgagatggagtctcgcttggtcgcccaggctggagtgcagtggtgcaatctcagctcattgcaagctccgcctcctgggttcacgccattctcctgcctcagcctcctgagtagctgggactacaggtgcccgccaccacacctggctaattttttttttttttttttttttgtatttttagcagagatggggtttcaccatgttagccaggatggtcttgatctcctgacctcgtgatccgcctgcctcggcctcccaaagtgctgggattacaggtgtgagccaccacgcccggccatgcccagctaattttttgtattttttagtagagatggggtttcatgatgttagccaggatggtctcgatctcctgacctggtgatcagtccgcctaggcctcccaaagtgctaggattacaggtgtgagccactgcgcccagcggaactgtaactctcttatctcaactagctgacattattacttcacatcctgttcaatttataaattaagagaggtgccatgggctgggcacggtttgttcactgttgtttgaatgacaaactcatctgcctttttaagaggccagtctttgatgaactttaaactttgtaaaactaatgcattgtgcctgtgtataaaccagtggttctccaaatgtgctgtgtggacctctcgggatcccgaagaccccttccagaaggcctaagaggtcataactgttctttttttttttttttgagaccaagttttactcttgttgcccaggctggagtgcaatggtgtgatctcggctcatggcaaccttcgcctcccaggttcaagtgattctcctaccccagcctcccaagtagcagggattacaggcacctgccaccactcctcgctaagttttgtatttttagtagagatgtggtttcaccatgttggccaggctggtcttgaactcctaacctcaggtgatccgcttgcctcggcctcccaaagtgctgggattacaggcctgagccactgtgcctggccaacactgttctgaatcatactaattaaacctgagaaagctgatgaaaaattttaaaaatttgtgaaagtaatacaaagtcattgcctgctttttcattgacacttgccatgattatataaaagcaaaagtgggtacaatggctggtttctcagcataaatcaaggcagtggtaccaattacattagtagtcattctattcttcactgtcccctacaggtaaaaaacatagcctgaatttcttaagaatgtctttgatgaagcagtaaaaattaatgttgttaaatcttgacatgtctctaatattctgaataagtggaaagttaaccagaagcgctttttttgtttgtttttaaagaatccgtgatttaactgtgaactgaaaaatcacttttttcacagaacatcatttttatttaaaagtacaactgggccagcgcagtggctcacgcctgtaaaatcccagcactttgagaggccaaagcaggcagatggcttgagctccttcaggagttcgagaccagcctaggcaacataacgaaaccctgtcactgtcaaacatataagaaaattagcctggcgtggtgccacacatctgtggtcccagctacaaaggagcctgaggtgagaggattgcttgagctgagatcatgccaatgcactccagccaagtgacagagtgaaactcggtctaaaaaaccagttcaactatcattctcaaaaataaatgaagtgagaggttgtcacttcaagggaaatacgtatttgttcccaatgataaaatttaagctttcctgtggactttgacaaacttgttccttctactgtaggcttggcagcttttcaatacttaaaggtgtgttaaagtaagattggtggttaaactgaaagtgatttttgacacaataaaacataaaccaatatattccaagtaactaatgcatgatattataaatgcaagtagtgagcaaaagatccatttactgtgcaagaaagatcaatgagtactgatggaataaatttattaatatgtaaaatgccaccgtaactaatttaagaaaccaccacttgtgaagttttgatttagtgttaacaaatacccacaactgtctgaaaactttaaaaatacaccttctaccaactacatatttgcatgaggttaggtcatcttattgcttctttttttctttttttgagacagagtctctctctgtcacccaggctggggtgcaatggcgagatctcggctcactgcaacctccacctcccaggctcaagcgattctcctgcctcagcctcccaagtaactgggactacaggcatgcaccaccacgcccagccattttttgtactttcagtagaggcgggttttaccatgttggtcgggctggtctcaaactcctgacctcaagtgatccacccacctcggcctcccaaaatgctgggattacaggtgtgaaccactgcgccccaccagcttattgcttttttgtttgtttgtttagacagagtcttgctctgtcacccaggctgcagtgcaatggcaccatctcagctctctgcaacctccgcctcccaagttcaagcggttctcctgcctcagcctccagaataggtgggactacaggtgcgtgccatcatgcccagccaagtttttgtaattttagtagagacggggcttcgctgtgttagccaggatggtctcgatctcctgaccttgtgatccgcccacctcagcctcccaaagtgctgggattacaggcgtgagccaccgtgcccaacctcttattgctgctttaaagcaaattgcaaagaaagctctagagaatccatttgtctcctattaagctcaacatgagagactttaaataatataaatacatgacgcactttttactcaactttttgttgtagaaaagttatttttcaatgaaaaaattctgttaacaatactgttctcaaggaatattttctgttgttataacctgggtcatgggttactactgatatctagttggtagaggccatgaatactgctaaactctctgcaatgcacaagacagtcctcacaacaaagcattatctagcccataatatcaacagtggtaaggctgtgaaatctaaactaaaaatagattttgaaaaaatttcaattgtataattctaccacactaaatatcaatataatcaatataaacacatactctttgagattctcaatcatttaagaattatgagactcttaaggaacaaagaaaatacaaataatttgcttcaatattttagtaggcacaatacagcttatgatgtctagagctgtgacctaacactgagcttgatatcttgcaaagtaattagctagaataacaagacaggtttctaaaaagctcacctttgtgtgatatgatgaggtatctccaaggtcacactgtggaaggaaaaaaaattcacaacaatagatgttaacatttgttaggcctgaagacattttttaaaaggggggcagaggaaactctcctagtggccctgaaattcaaatcttctagttcagaacagtaccataagggcactttgttttcatttctttgttttttacaaaaatatgagaaccaaaatgcaaggaaatatgccgttagaagacgcgtttctgttggtgattacaatatataaataataacagatttccttgttatatgcttttctacccacgaaacctttcgtcccatgcgatttattttatgtatttatttattttttgacccagagtctgtctctcttgctcagactggattgcagtggtgccatcttgactcctcacaacctccaccacccaggttcaagcgattctcatgcctcagcctcccaagaagctgggactacaagtttgtgccactatgcccagataatttttttttggaggggggcagtgggtggagtttcgctcttgttgcccaggctggagtgcaatggtgtgatctcggctcaccacaacctctgcctcccaggttcaagagattctcctgcctcagcctcccaagtggctgggattacaggcatgtgccaccacacccagctaattttgtagagtgaggctcaaaacaactgagggaaggcaaatctcaattctactaataggtctacacaatattagcactttttaaaaagcctgtaacattagcaggtaagatggatatgtctatggtgcttcaagtagttttcatctctgaaataattttaaaatcacagaatttaaagttacatgctggaaaggaccaatgaccttatgtgacatttaattcaacactcattttacagatcagggaaacagaccttaaaactgacttgcccaaggtcccaccaaataggagcagtttctcatcctaaactcaaattaagcagtggctctcaaactttgctgcacattaaaatcacctgagaagctttaatatctgcctcatcttccacgagacattttaatttaattagtattgggtatggctttgggcatcaaggttcttagtaaacgtttcccaggtgatttcaatcagcagcaaagtttggaatgattgagttggggtgaaaatcagaatcttctgggatgcttttcttcacagaaagatgcctcacatccatcccgattttcctaaaaggcttctcagtgcctagagatagagggaaagtggagatgggaagatacatgtgtttgcagacttgtattttgaaaaaaaccttgcataagtgatctcagcgagttccacctatcccactgacaacagtgcactactgattcatgataaaacatttttcaaaatatcttcttgaagccaatttgccctattaatttgttcaataactttatttcgccaatagtgaatacaccaaatgatcatttctcaaacttgctggtggcaaattaaaacttactatactctcaaaagtagacttctaaaaagtagaataatgaggaaaaaagcacgaaatttgtttcagcaaaattaatcttcaaagctgcttttgaattatatgctaacatatcaaaatctttggaactcagaagaagccagggactctagtcaaagtaatttttgtgtatgtgtgctcagagatttaagagacttagctgactacagacatttagtgattactcaataggtcccaaagctcaggacttgagacagagtttgagtccagtttttgttcgaaacacaatttcctctcaactattgttaaaagggagggaggaaagtgacattattatgagtgtaaactttccacttttaattgaagtaaaagttattgacaattgaattagttaaaaaggctagtgcatttgaaacaaaattgtttataagctagttatgtgtacagaatgaaaagttaaattaaagataaagacattaatattctaaattagcactttccaaactgtgttctaaaaatcaagactaataacccaaggagatgagaataatgtacactggacagcccctgtggagctggtggtggtgttggttgttgttccttttaaaataaacttcatctcagggtgctctcaaagcacatctttgtggcccatgaggtgctcatgcacaatgggagaaattcaaatgcagatacactgtggtgccagaagaagaaaagctgttccttcctccaaggataatgtccaaagtagtgcacactgatttaggcctatgatgcattgaaaaactaagtttccacaaaaaacattcaataaagggaacctatccttctcactgtgttcaacattgtctaaaggcataaaggcatcaaaaagatacactgtttctgggattgcttctttgctaactgatttttccttccaccacgacgtctaagattaaaagagaaactgatacttaatattcagaatctggatatcaatatatggttgactccaatttcttaaactgattgctgaaaaggacaaccaaatgactgaaataattttagaataaaggaatctgtccctcggcagcatagttgtactcatgatattattgtcattgtaagataatgctggatggctgtgctgtcatcaaggaatattgtcgaacacaagctgtattgttgactgaaacgcacagtagatacctgaaggggaagggaagtgtaagtcaaacttatgaaagtgtattattttctcagttaaaatgtcaaatgacaaagcactaagatatgtctcacactccatgaactgcctgagtgtggtatcatgtgcactctatagaaaacccattggaggctctcaacttccagagatgatgtttaagatatgggttataaaatgctgcccttaatatggtacctgtcatcaaacctaacaaggattttatgaattaccgttaaaaataatgggaaaagtctgcttcgaggggcgcggtggctcacacctgtaatcctagcactttgggaggtggaggcgggcagatcacgaggtcaagagatcgagaccatcctggctaacatggtgaaaccccgtctctactaaaaatacaaaaaattagccgggcgtggtagcaggcccctgtagtcccagctacttgagaggctgaaacaggagaatggggtgaacccaggaggcggagcttgcagtgagccgagttcgcgccactgcactccaggccggcagacaaagtgagactccgtctcaaaaaaaaaaaaaaaaagaaaagtttaaaataagatttcattttttttctgcagcaataaaaagcagctgagaatttctattaattaattaatttatttatttatttttgagacggagtctcgctctgtcgcccaggctggagtgcagtggcgcgatctcggctcactgcaagctccgcctcccgggttcacgccattctcctgactcagcctcctgagtagctgggactacaggcgcccaccaccatgcccggctaactttttgtatttttagtagagacggggtttcaccgtgttagccaggatggtctcgatctcctcacctcgcgatctgcctgcctcagcctcccaaagtactgggattacaggcgtgagccacggcgcccagcccttctattatttatttactacgataaaatgtaatgtattaaataatcctgctacaagagcattttattgcagtgaatacaagactaatgcatttactaaattactaatcctaaatgtattatttcaggtgatattgttacaaaagaagtgtttcagattcagaggctctgtgtgccagggctgctaggccaccaacaagtgaggaagccataggtttctctagtcctattttcttatgtggaggataaaaagagtatcacttaaatattctctcacaccctgaaaacaaatgacaacttaaaaaatctaactttcacttcatgtttaaataagactgccaagacatgactcaaatgagactctcggagaatactttgcattcacttcaaaacttgatcaattgcattctataaatcatctgacctgcacctagccattttcctgctctacccctgctctctgcctagaatactgcttttctctttccttgcttcagcaagctcgactccatctaccctcttggatctctttgtcggcagccacaccaaaaaatgtatttttatacactaattagttgaattcaccactgcttacaagatgctaattcctgcagagtattccccttgtgagaaagtatgcctctccataagagtaagggagggcccttactcttcctacctccagctgctgagcatagaattttgagtaaatccaaaacttcgacaagtgtttgacaattcagttatcatttggaaggtaagtcttactacatttaattacagcaaaaacactactaacagtttactctttataggtattatttaaggtagtcacaaaatagaaacaaatactctaacgtcaggcagcataaatgagagtatgaaattttacaatatttaacaagaaatggaaggggttacttagtagttttaaggtttaatgacaaaaactagaaaataatcgtacctagtaatttagtaagtcaaaaccaaagccttaccatcaaaggtgcagtacccattggatgcggatgcccacgcactgacttcttctgctgtacctgctgcctctcattttaacccattaaaaatactaaagttgttttccttgtagacatgtttcacctccttggttaggtctattcccaagtattttagtttagtttagtttagttttgcagctatcagaaaaggggttgagttcttggtttgattctaagcttggtcgcttctggggtataacagagctactgatttgtgtacattaattttgtctcctgaaactttgctgaattcatttatcagttctaggagctttttggaggagtctttagggtttcctaggtatatgatcatatcatcatcaaacagcaacagtttgacttcctctttactgatctgcatgccttttattgttttctcttgtgtgattgctctggctaggccttccagtagtatgttgaatacaagtggtgagagtgggcatccttgtcttgttccagttctcggggggaatgctttcaacttttccccctttcagtatcatgttggttgtgggtttgtcatagatggcttttattatattgagctgtgacccttgtatgctgattttgctgagggttttaatcataaaaggatgctgcattttgtcaaatgctttttctgcatctgtttagatgatcatgtgattttttgtttttaattctgtttatgtggtgtatcacatttattgacttgtgtatgttaatccatccctgcatccctggtatgaaacccatttgatcatggtggattatcttttttttttttttgagatggagtctcgctctgttgcccaggctggaatatgcagtgcggtgatcttggctcactgcaacctctgcctccgaggttcaagcgattctcctgcctcagccacctgagtagatgggattacaggtgagtgccaccacacccggctaacttttgtatttttagtagagatgggacttcaccatgttggccaggctggtctcgaactcctgacctcatgatctgtccgcctcagcctcccaaagtgctgggattacaggtgtgagccaccgtgcctggccggattattttttgatatgccgttgggaactacaaaacgttgctgaatgaagtcatggacacaaacaaatggaaagacaccccatgctcatgaatgggtagaatgaatattgtgaaaatgaccatactgccaaaagcaatctacaaattcaatgcaactcccatcaaaataccaccatccttcttcacagaactagaaaaaacaatcctgaaatttatatggaccaaacaagaactggcacagccaaaacaaaactaagcaaaaacaacaaatctggaggcatgacattacctgatttcaaactatactataaggccatagtcgccaaaatagcatggtactgatataaaaataggcacatacaccaatggaacagaatagagaacccagaaataaactcaaatacctatagccaactgattttcaacaaagccacctaaaacataaagtgaagaaggtaaaccctattcaacaaatggtgctgggataattggcaagccacatgcgggagaatgaaactggatcctcaactctcagcttacacaaaaatcaactcaagatggatcaaggacataaatctatgacctgaaaccataaaagttctagaagataacattggaaaaacccatctagacgctggcttaggcaaagacttcatgaccaagaacacaaaagcaaatgcaacagaaacaaataggtgagacttaactaaagagcttctgcacaggaaaaggaacaatcagcagagtatacagacaaccacagagtgggaggaaatcttcacagtctatacatctgacaaagggctattatccagaatctatgaggaactcaaacaaattacaattacaaaaatatggaaccagcccaaatgcccatcaatcaatgagtggataaagaaaccgtgatatacatacatatatatatatatgaggaataccacctcagccataataaggaataaattcatggcattcccagcaacctggatggaagtaagactattattctaagtgaaataactcagcatggaaaaccaaatatcatgttctctttcatacgtgggagctgagctatgaggatgcaaagccataagaatgatacaatggactttggggacttgggggaaaggctgggaggagggtgagggataaaagactacaaattgggttcagcggatactgctcaggtgatgggtgcacctaaatctcacaaatcatcactaaagaacttagtcatgtcaccaaatgccacctgttcccccagaaacctaaggaaataataaataaataaataaagtacagcatttttctcagcaaacataaaataaaacaaagactaaagttcatatttttcactctccttttgggcaggacaaattttagataggtttttaaagaattagtaacttttttcctttttccgagacagggtctccctttgttgcccaggctggagtgcagtggtgcaattatagttaactgcagcctcaaactcctgagctcaagcgatcctctgcctcagcctcctgagtaggtaatacgaaaggcgcatgccaccaggcctggctaattttttatttaacctttttgtagacatgaggtcttgctatgttgaccaggctaaaaatgaacaaatcttaattaacttaaatatttctaacactttgggcattcaggaaaacagctccatctatgttgtgaagtaatgggaagtatatggcagtggataaactttgaatgaaaatattaaacaaggccttaggagaaaagtgtaatatgcttattatagatacattaatttaaaaaattctctggcttaatataattaattatactcaaattagattttgatttaaacacaggtcctaaatttggattaaatataatagattgaccacaaatttatttcgtctccctccggaagcctcattagtcataaaataaaggttacacccatgaccagcacagaaggttgacagagataatttttaataaatgctgagacataaaaagtagataaaggagtggtaaataacacagaaacacaactttggtgcctacagaaagtgactggaacagaagcgagccagtttatcttgcagaactaaaggcaggttgtgaacttacaggcaaatggaactttggaaagtagggtaaaatgtgaaaaaaaaaaaaaagccagcaaggtcagttgcaaatctctaactagagccccaagtccacctgtccttccatctgacaagaaacttagatgtgtgttctctggatatatcaaacctgagaatttctggctcagagataccatggcttaaacctgagatataaagaaaactgtacaccaaaaatggaactccaactttcttcgctaactctgtttttcctttccaggcctgcttttactttccaggcagaaaattgggagatccttctcagaagaaactgaaatgtcttcaataaagatccccagataatacactgaggtctcccaaatgaaaagctagtcaggcttctaaggcctcacactgagtgctatcagttaacagaaatcctgcttccaaataaagcaggccagggaccaccacacattggagggaagcctccaagaaaagagatcaaaacaatagaaaaaaggaattgataggaccagtcaaaatcaggagcaaaactttaaaaaaaaatcttaaaacactctcaaaaaatataaaattcaatagaaatggtagaggataaagtcacagaatatcccagaactagaataaaaagacaaactgaaaaaaatacaaggggaaaaattaaaaatcaatgcaggcatattggtctaagcagcctagcatctgaataacaagactatcagtaaaaaagtaacagagaaaataaaaaaaaattctcaagaagagatagtctgcaggtttagtagcctcaataaaatgaaaagatccccaacaagctgttataaaatttcagaaccttagagagagagattctaaaaagcttccacagataactaaaacctggttgtaaataacgtatcacacactggcaatagattcaagaacaacactgtaataagagcacaactgcaaaatgtcttcagaaccacaacatttagattcaacctagaggtgtactctctatcaaagaggagggattttaacatctccacacaggaaaatgtgttcaagtacaactagagacgataacaggacagaaggaaacacagaatctaggactcaggtgatcccacacaagacagcagttacgtgagataccaaaagactttaaagagttagcccagaaaagcagacattgagcatatctagggaaacccacgctatattgaactaggatgacaaaaggccaaagaaagttgccccccacacaaacataaaaaggaacagatgtgttttcgcagatggaaaatatctttgaaaggcatgtgataaatgctacaatacttgggggaaaacagctgttagaaaacaggcaaatgaatatagtcagaaaattagcttcatgctaaaaaataatggatgtgaaagcaaacagagcacccagaggctacttaacgatatttggatagataaactaatgtaggctaggaaaaaagaagatccaggagaattgcagaagtgctcagatttcagaactgtttcagagacaggatgaaggacatggaatgcagaggcacagtgaaaacaccatatgacttagcagtgaataatatttgcagagtcataatcatgtaaatattactgatttaattaaaaagtgtgctacaattggaagaaacacagggagaaacataagatcatggtgtagcggggaaggtatgcttttacctgctgtgacagaaagtcaatagacagtgctggcaattaacttagctattctatttttgttctttcattaaaaataagattaaatatttaaggcaattttttttttttttttgagacagagtttcgctctgtcgcccaggctggagtgcaatggcgcgatcttggctcactgcaacctccgcctcctgggttcaagtgattctcctgcctcagcctcctgagtagctgagattacaggcatgcaccaccacgcccagctacttttgtatttttagtagatacagaatttcaccatgttggtcagggttgtctcaaactcctgacctcagatgatcagcctgcctcggcctcctaaagtgttgtgattacagacgttaaccaccatgcccagccttaaggcaggtcttttgaaccggactattgaaatttaacttaaatgtcagaaatctttaaaaggtggacacgctaaactaagcacttttctggataaatttaatactcaggaaaatagaagagatttagaaaatccacaaaaagaggtccatgctaccaccaccaggtccacattgtaatttaaagaaatcaagagagacatccttttatgtcaaactatcaatttcttaactatttgagtgtttacttacatggtttgtacagttgcttcttcttatttctacaactaagaataaaaaaaaaaaaactggtcacttctgatacaaataccataaaataaaagtagttgttaacatcttactgattactcctatgaaaaatgagacaaaattccattaaaaaaaaattttcaataacatataatttaaattatctggcatgattaatttcataagtcaaatctaaaaacttagattttcatttagtttactttttgtttctattacatacaaatgaaagaatcctcatgtacaaaagaaaagggcaaaaaaattaggccagatgaaaaatttagctaataaaaagtttaactgttgcatatatgagccatgatccattagtattctctcattctgcatttacacatagcttactttaattatcagactctaagagctaacagttctaaaaactacttcctgaccagacacctatctctagatgcaacagaatccctgtaagcatcttgaaccacacttagtggttatctactaatatgtcactaaaaacaaaacaaaattaaaaaatggtctttacacaactggaaagtaacctatcttaaatttgttttcttttttgagatggagtctcactctgtcacctaggctcgagtgcagtggcgggatctcagcgcactgcaacctctgcctcccaggttcaagaaattcttcagccttagcctctggactagctgggaccacaggcacgtgccaccatgcctagctaattgttttttgtatttttagtagagacagagttacactgtgttagccaggatggtcttgatctcctaacctcgtgatccacccacctcaacctcccaaagagttgggattacaggtgtaagccacagagcctggcctaaattttgatgttaaaataagtatacaaacctaattggacatggtgtctgcagcacaaaaaaatcatttttttttccctaaaaagaggccagaataataaaagccccaagagggacttgggccatgctttgtttcctacactgcctctgcctttgatgctgggagggccttgtaggcaaaagttactaccactgaagagtgagggacatggaatagcttttcttttactgcttccatgctctctaggtgtgagaagcccatggctctggaaggaactgggaaatacaattctgatatgttttggatatgttgcccctccaagtctcatgttaacatgtgacccttaatgttggagatagggcctagtgggaggcgtttgggtaatggcagtgattccttatgaatggcttggtcccatccccatggtaataagcaaattctcattacggtaatttaaaagactgtggtactggccaggtgcggtggctgaagcctgtaatcccagcactttgggaggctgaagcgggtagatcacttgaggtcaggagtttcagaccagcctggccaacatggtgaaaccctgtctctgccaaaaatacagaaattagccaggtgttatggtgcccacctatagtcccaactactcgggaggctgaggcaggagaattgcttgaacctgggagatggaggttgtagtgagccaagatcgtgccattgcactccagcctgggcaacagagtgaaactccatttcaaaaaaaaaaaaaaaaaaagagtgtggtaccttcccccttcccctctctctttcaccgtgtggaaccacctgcttcccctttgccttttatcatgattgtaagtttgctgaggccctcaccagaagcagatgttaaagccatgttggtacagcctgaaaatctttgagccaattaaacctctttttgttataaatcacccagccttaggtatctctttatagtaatgtaaaaaatgaagacaaattctaaccagaaataactgactcaagatgggcaaagtctactcaaactataaaaacaaaggttacaaactcccgtgttttactgtgctgcattacttcgcacactattatagaaccctcacttgtattcttgctgtttaagtcaactggaaaacttggctgtgtatggcttgttggcaaataaatgaggatttaacataacattaagggaaataagcaggagtagggcacgtttaaatttacattacatcgaatgaaaaagttaataacctaaaacttttgagtagcatgaacttggatgtggtaaatgaatgtggtcagaggactgtgtaagaggaggcccaaatcacagattcaatccctgatgataaacaactatgttttttaagttgtttaaatgaaaaccaagctgaagcctaagttctatcattcatctttaaagtgtactttttggagcaagggaaaagggattataaataaagataaatccattaattataaataaagataaatccaagaattataaagagaaatccatgactcctccatcacatcacaaattaattgtgttgataaaaagatggcaaaatgtataaacaaaaaggttacacattttcactaacatcataacaactaaaggaaagtatatcacatattaaaataagacaagtgaacatgtgaaaaggtgaaaaatttaaaccaatatgagtttttctaaatactttctataacctgatcaaacaagagattttattctttctcttggcggaaaaaacaatgtcgtctcaccatctgtttgagagttcctctggaatattgtgtttgcctctggattggcagaagggttaaactccaaagctatatgcatagaggaagaaaagaaaaaaagatgtaatcattgataaaaatttatcaactcatttattcgactgctgcatttaggctatttcactatctctactttgattcttatccattgaaatgaatgtatagacataagatagagccaggcaagatggcacatgcttgtagtcccagctactcaggaggctgagatgggaaaatcacttgaacccaggtcaggaagttgaggccagcatgagtaacacaatgacaccctcctttatttaaaaaaaaaaaaaaaaaaaaagaggtaaattttggctttgagttgtgtaaaatcaactttgcataaaataaatcaagatagcagtaagttttaaaagacagtctattttataggcaaaatataagatgtattctagagtttttaaaatgtttaaaaagtaaattcatcatatctgtcacttccatttcattctgaggacacagaaccttagttctcttgagtagctgtcttccatagtcatgtgatatctctaagttttcatttcttcattagcaatacatagggagaacatacacaggccttatttgtattggaaagggccaagtgagacatacataaactgtgttgtaatcctaaagaatgacaataaagagtcatttttgggctctcatccaacactacccatctactaactggtgtgtaacatccatcaggctttccgaacatcaccaagcagagtataagtttacacaagtacttacatgctttgtgtataaaggtacaatcaattaattcacataatgcatttgtttattctaaagcaatccttaaatatcttgaaatgtgaagatagtacttccaagttacaaagtcacactcataatgagtcttaattatcctacctctttaaaaattaagagcccgaccaaagtttaaatagaagagctataagacatttcctctacagtgatgaaatctctggcatttaaatgaaaccaataagccaactggatttaatatgtttatgatgcaatgttttctattttgaaaatttcagtttttattcaagaaccatattattacccagaattacttttacttagattcatctctttgcaaaattttagaggcaaaccaactaattgttttctcttttctaccggctcccatcccctgcctctgccagcagtgtagagactaaaaaactccaactttctttcctttttttttttgtgagacggagtctcgctctgtcacccaggctggagtgcattggcgtgatctctgctcactgcaacctccacctcctaggtccaagcaattctcctgcctcagccttgtgagtagctggaactacagtcatgcgccactacgcccagctaatttttgtattttcttttttagtagagacagtgtttcactatgttggccaggctggtctcgaactcctgacctcaggtgatccgcctgccacggcctcccaaagtgctgggattacaggcgtgagccaccaagcccagccaaaactgtaactttcttatctttgaacaagatgctattgtcaggaggggaagggacaaagggggagccatggcaacaaacactctaacagggaaggtctgccattttaacctgcaatctttatattacacattaaaagtctacattgacgtttcatgtcttttgaaagttttgaccatgaaccaatccccacctctcttttagaacaaggaggtaaataaagtctgttaagtcaccagaataaatctggagacacattttctgttaaagtaagaattttaaagtaatcagagcctcataggtaaactcctttgagaaaccccaaacacacacacacaaccatttttctgcagccccggctgtgacatttcacacctttcacaattattttaagcattctccttttttctttttccttctgtgttcaaattacagttagaagaaactaagcagcttctatcaaggtgacttaaagcagcccattaagaataccatatagcctctcccgtggcaacctccattctgattttaaataagaaatccccaaatatttgaataggaactgtcctgagatttggctactttaacaaaggaaacaattaggcacttacctggttccttcacttaggtaccatctggataggtacaaagaaaaaataagatgggtactgaaaagttgggatatttgagtttttattgagaaaaggaagagaatagctcaaagaagcctaaacaaagtcccacaggataataaacagagctacagacactgttgtctcaccatctgtttgagagttcctctggaatattgtgcttgcctctggattggcagaaaggttaaactccaaagctatatgtatagagggagaaaagaaaaaagatgtaatcatttataaaaatgtatcaactcatttattcaactgctgcttattcgacaagagccataaataaatggccccatgccagcctgggagaatgagatgagagagcaagaactgggcgattgggaggggaggcgaaaagaaactgactggactcggtggggaaagactaaggggtgggaattcaaggcagagccagcttttgttcctggccagcccccgggaaagctggctacaagcagaaaggagctcgaagtgggggatgcctcaaagggaaccttggggacagcagcagccaaaggcaaaccgagggtagatggcacctatcacctccttaccttcaggcatctcccggtcacgaacgtggtgcatgtggaggtcctcaccaacttcaacagtcacctcagcaggctgtacagcagcagccatgggcgctcctgccatcctgtcctcagctcctgcctcatagatctcagattcagagggacacaccgacccctgctgctggtcaaactcgaggctgacgctagggtgcacacgacaggtcagtatgttccccatggggcgcctctactgtctgccaccacctgtgcctctgctcacagctttggccacgcactcccgctgtcctaggccgaggctatgctgcacttgcagagatggtcttcccgctcctcgcctgcccacctcacagcgcggccccgggcaccagccctggccccggccccggccccggccccggctagggctgcgggccaaggcccgcaccctgctgcctcccctgagttgacttgtctgggagggtgaagaccagccggcttatttaataggttgtgaacccaacaagcgctgagagacacaacaactgcctgaaaagagaacagacggagctccttctccttctgtagtcacctacagactgaagcccactggccccaggtgggagcccaggcatgtggcacacaatgccccaccccacacttcacaatgccctccccgacacctcacagtgccccaccctgcctgccacccctccccaacagctcagaatgcccctgccttggctgccccaccctgtggcttatgatgctgctgctctcctggcccctcgtgcagtgccagtgggactaaggttttcattcatcaccagcttcctgagattttagtcctaagaaaagcacagggtagttcattccttgaagccagcttcctctatgagttctatacaaagcctcagtagagtgggtcccattagcaaccaagttgaacaacttttatttgctgtctgaatatagatacacctgaattgttgactgcttttgtaactaaacactcctctcctgtcttccaacgagtggtcatttttgtccgcaacttgaccacagcaatccctggggccctagctctactctcaataaagagttatggctgtgtgttttgaatgacaccttaggacccatcctgcctccacctccttctccataaaatagaaacctaactggcacctccaagctctgaaatgctgaaacttaccaactcccttttctccccgctatttcttccttccatggcagggactttcaggttttctttcttttactaacaaggcactaagcatgattttctcatacaaaatcgagagccataaagtggcttaccacagtcctatttcaataaagatgaatactcgacatctggcaagtagtgtgtgcctgacagtgtccccactgtgctatgctcatttaaccctcagaaacaatctcatgttacagattttacagaagttgttgagatggagaaggtaagtaacctccccaaggtcacatgactgctaagggtggggccatggtttgatcccaggtagtctgaattccccaattgcttaagcatgagtatcagaaagtatagcagtctgttttcacactgatataaagaaacacctgaggttgggtaatttttaaaggaaagaggtttaattgactcagtttcacatggctggggaggcctcaggaaacttaacaatcatggcagagggggaagtccttcaggaaacttacaatcatggcagaagggcaggtccgacttacatggtggccgcacagagagtgggaacatgtgaaggagcaactgtcaaacatgtataaaaccatcagatctcagctgggcacggtggctcacacttgtaaccctagtactttgggaggccaaggcaggtggatcaactgaggtcaggagtttgagaccagcctagctaatgtagtgaaatcctgtctctactaaaaatacaaaaattagctgggtgtggtggtgcatgcctgtaatcccagctactcaggaggctgaggcaggagaatcaatggaactcaagaggcagagactgcagtgagccaagatcatgccatggcactcctgcctggacaacagagcaagactccatcccaaaaaacaaaacaaaaccctataagatctcatgaggacttactgaatatcacaagaacagcatgaggataactgcccccatgatccaatcacctccccctaggcccctccctcgacacatcaggattatggggattataattcatgatgagatttgggtggggacatggcaaaaccatatcagaaagtaaaggtagaagtcaagcttggatgggaaatgacattgtagattattattattattattattattattattattattattattttgagacgaagttttgctcttgttgcccagtgaaattgtttctctaatttcattttcagattgtgtcttgtagatgtatagaaatacaattgataaatgattctggctattaaccttttatgcttcaaccttgctgaacactatttttttttttttttttttttttttttgagacggagtttcgttcttgttgcccaggctggagtgcaatggcgtgatcttggctcactgcaacctccgcctcccgggctcaagcggttctcctacctcagcctcccaagtagctgggattgcaggcatgcgtcaccatgcccggctaattttgtatttttagtagagacggggtttctccatgttggtcaggcccacctcagcctcccaaagtgctaggactacaggcatgagccatcgtgcccagccagattcgtatatttttaaaagaattttttttactttttattttttttttgagacagagtctcactctgttgcccaggcagtggcacaatcattgctcactgcaacctccacctcctgggtccaagtgattctcattcaagtgcctaagcctcccaagtagctgggattacaggatcccgcccccatgctcagctaatgtttgtatttttagtagagatggggtttcaccatgttgctcaggttgatctcgaactcctgacctcaggtgatccacctgccttggcctcccaaagtgctgggattgcaggcgtgagccaccactcccgaacagaacaacatttttttgatgtggattttaaaatgcctccccttctttcaacattgattaagtcccttctacatgccaggcactgtatgtgtgaaatagtcccaactctcaatgagtgtaggcagatacacaaacaaaggcttaaggaggtcagttttctgagaccatactgctggacagtatatgaacctgggatacaaacccacctctatttgacctcaaatttgatgctggggtggttttaattttattctgggaatttcagtcattcaaccataaaaaggtgaaaagtctctgtcagatgtgcgtgtagtggtctgtataataaagactgaaggaagcaaccaaaccaattaagagactttctctaaaggcagagtaatgctaagggcagtggcagtgacaaaagtggaggaaaaagtctgtgatcatttgggagacagaataggaagtgcttggtcatgagatgtgaaagaagaggggaagtagaaggaaaacagagctgctcaggctctgctggggaagactgggtgtgtagcagtgccttcctcctggccgagaatgtaggaagagaaataggtaaggaggaaaagatagttttttactctcagtgtcacattaaaatggaactctctggtcaaaagttgaatataaatctctgtaggctaagtccatttgtgacatcccaacatatgttttcaaaaataacatacacactaaatcaagccattaagcgtaactggggaaatttcctaaaatttacatgctaaaaaatcaccatttttcatttattactttcatggagcaactttgaatctatggttacagcaggtgaggcaccttgtataaaataaagctaatacatgaaataaaaccatttaaaattctattgttctcagagaatggagaaagcaattgaagccatgggtgtggaggtgactgccttgagaagttgtgtatagtaaggagaactgggaagaaagaagacctggagaatagggtgatttgcacggcattaagtgaagcttgaaaaagtgagcactgagactcaagagacatgtatgaatcagaaatggctgctcctgtgagttgttagaaaggagatgatgccttcttttcatatctataacagtagcacctagcacagtgcctgttcaataggtactcgacatgtattatcccaatgcagagtcaaattttgccaggaaggcaggaaagctacaaattagctatggcaacttagtgattgggcttgggtgtgtgtgtgagcgagctggatgtcaggcagtgggcaaagtagtgaactggaggtgagaaaacaatgacacaaactcagggcttctcttcccaagtatttggctgagaagagagatgtagtattaaagggagatatgtggtaaaggaagccttttatttcaagattcaacaaaagcgtgagtatacttctatgttaaagggaaagagccaatagagaaaacacatttttgaggttagaagagaaggaagaactaatgcagaagggccccaaaaggcacaggtgcgtgcaatccggatcagggacagattagctttggattcctacaaaagcaagaagggagaaaggaccatgtgacactagagatatttctggtaaaggaaaggtttaggaaaatatcttttgatgacctttattttaacataatttttttttttttttttttgagatggagtcttgctctgtcacccaggctggagtgcagtggcacgatctcggctcactgcaacctctgcctcctgggttcataccattctcctgcctcagcctcctgattagctgggactacaggcacccgttaccatgtccagctaattttttgtatttttagtaaagacggggtttcaacgtgttagccaggatggtctccatctcttgacttcgtgatccgccggcctcggcctcccaaagtctgggattacaggcgtgagccactgcacccggctagactttaaaaaaaaaaaaaaatactgtgggaaaaaggatattatgtatagaaaagtctacacttcttgatacaactaactaaaaaaagcctgatacactaaacaaaacccaaataatgtcttccctaaaagtgggtaacttgaaaagcaattcgagcaaaaatcaaggagttcaattataaataagtatatcaacaaagtgaaagatgggtttaatttttcccacaaaaagttaaaagaaataacagcagttttagaggaagaggaaaaaataataagaaaattatatgcagttgcaaaatgtgtgactatttacaaactctaacatataactacaaaacggaccagaagaatcattatcataggaagcaaagggtcatttcaaaaatcagaggagggatgattcatatttaatttaattctgtggaaaacatttaagtaacctttgaggacaaaaataggtgatatgttgaaatgcgggaaaccacagtggaaggaaaaagaattcaagaaagctcagtttcagtaaccagtatctagtaaaatcttcaggacctagaggctacaatctgcattaatagtgtctgaagacctagaaatgtcattaaataccattttggataattcttgtagacttgagatgatgtctatttaaagttacaagacagtgcctgtatttctgtattcataacagaaaacaattggatatggaaaagaaactaacatgctatgccacaatctctaaagaaagattagggaagtttcagcttaaagcaagaataatcacaataaagttttacaaccctttgcaagcatatatgaaaaacttacaaaaagtttgtaatgatcttttcttaagctaagagaatggaaaaaatgagaaaaattaaattataaaatgaaactttggtttagaggtaagaaacatttgatgacagtcaagagatcagggttgtacagtgtattatgtgaatgttgtgactcattggtttcatcttggatatcataacttgacattttgtaaaagtgatttttcatgggagttttttcaggtgccctataaagtcctgtcccatgagaagcgaataatagtcttccatattcttgagatatcttaatgaatagcatcttctacagtcttccattgtttagtccttggagagacactcattagtgactgttaaggtacctgagttattaggtgcctgtagactatgcccagtgatatgtgcattaggtacatgctccctagctgcgttgacactgactgaagctgtgaggtttcacaatgacatgtcagccaaatacatatgctcagatttaccatttatcaagaggtcttcacactatcaattgtgcaattatcattctacacacaggcagcgataaagggagtaaaaaaacacagccatggatcgggagactaaggtacctccagaggagtccagtgggtccagaagccctttggatgttggtcagaggctcctcttgggcagagatcacagcagcagccaacaggtctggtgaaatccttaagagttctcatggacaaagtttgtgaaggcatcttagacaagatcttgtctttgctggttttatgatcctctgcagatgggtctattctcattatctcagccacctttcacttcctatcagttcagttcaggtctctcatgatcccaggcagcagtagttgttatcacgtgagttcattcatatatgtttatctctttggggatggggggacaacttcactgtggacttaattctactggagatgagtgaccccattttaagacaacatgatcacaaattattatcacatatcagcagggcagacaatagctatgacctggggctgaaagcaggtaactccatttattctgcaaacattgtcttgattatggtgccagttgctgtgagggatttcctttccaccacctgtttttcacaaggtttgagtctgaactgctaacattctactgatttctgggtgaagggactgactgcaccatcctagcctgtcagagcattcgccccaatacttccactttaagagttttccaccttgtccagaactacagtccattaatcccctcattttctctcttaagagaataaacaggccaggcgcggtggctcacgcctgtaatcccagcactttgggaggctgaggcgggtggatcatctgaggtcaggagttcgagaccagcttcacttacatagtgaaacctcgtctccactaaaaaaaataatcacaaaaattagccgggcatggtggcaggcacctgtaatcccagctactcgggaggctgaggcaggagaatcccttgaactcgggaggcagaggttgcagtgagccaagactgtgccacagcactccagcctgggcgacagagtgagactccctctcaaaaaaaaaaaaaagagagagagcgagaataaacaacccatgtcaagtacacacccacatccctcttatcccaaataccaaacacacaaaaatccaatctgtctccttctacctaagcaattttagatagtcactttctcataattaccttaagctccctgacttgctgctcgtcctttctctggcaaaatctcatccttggatgagcccgactttgtgtttgctcaatgacaccactcacctgaaccagaaaaaatatcaaaaagtggtcagagatatcatcataaattcaaattacttacacaaaaaaattggccctaaatgtttccagaaatcaataaaagttttgtttctccaatgacatcatttcttcagaaacccaacgtgtataacctattttttctatgttcttctaacatttattcaacttctctcatctgatatcttgccaaatcattcaaagagaaaatatatcccattaggcaagagccgaccatattcccatcacctgagaaaatcatatgcacaggatgcacccacctcacctttctctgcctcatcatgtcagaaaaagtacccctccttttgccacaaggcaaatctgagataaaagatttagatggcctgtaattccagcacttggggagaccaatgcaggcagattatttgagtctaagagttcaaaagaagcctaagcaacttagggaaactgcatctctcaaacaaatacaaaccattagcctagcatggtggtgtggtggcacatgcctgtagtcccagctactcagggtggggagcactgaggtgggaggatcacctgagctggaaggttgtggctgcagtgagccgtgatcacgtcactgcactccagccagggtaacagatattttttaaaggatcttctctgttaaaaataatccaataaacaggtggccatgaggctgaggtggctgccgtgcactcaattcctccttaaataaaccaaaacttgactcagtgtaaataataaaaggaaacttaagcttaaccaatcagaaaccaccaactaacatctaactagagaccttccactgtaatgttccaaatgaggccactgctccacttcacccaatcaagtattttctttttcttccacattcaccatataaaattcttcccccaccctccctaagcctctctgtgggacctctgagctgcttgcagtctggggctgcctagtttatacatttctgaatgctcaaatatattttctaatgtttcaaagtggctctggtgtaggaggttgttggtggagtgacccgagagtatacaggaattgagggcatatgagatctctggactctgcactccattttgctgtacactcaaaactactctaaaataataatatatctttaaaaatctataactagcacgtagcccttttcaagcctccaactggttggagccagttcgattaaagctcagaagaaaaactggttaataagctagttctgacccaactggcaagaagcagcaggaaagacccaggccaggggagcatattgcacatgcatgcaccaggaaactggaggaagcttggaggccctttagcctggtcctgagcccgctgaaactgcagttacaggcacagatgcctggggcaccaatctgaatctgccaacatccaaggccacatgaacacaaatgcgcagtctcctctgcgatcggtagctaaggatgttaggccatgattggactaggatgggagatgaactgagaactctggattctgtaggttgttgttgtctcttcccacccccaagcaacaagtgatgaacacacacacacacacacacacacacacatcctgtagtgactaacaggatctccctccaggggatttgcagaaaggggagcagaaaacatcccaggggcctttcacagctacttccttgagccccctttcagactgctgtctagacctgtcgcagcccaaacatcatcaccctgatatgcagaagctggcatccttacctgaaattcaacaccaagaaatgatctcttctactcaacactgatagaaatacctctaagcaacgtcctcattggcaggggtggagtgggggagtttcttaaaaagggaggcctctgcctaccacctagagaacctggaaatttccatctgtgccacaaagtccaaatcactagccactgccccagtgtatggcagattagaacatctctccattagatctgggtttctattccattgagtgaaatggcttttctattacaggaacagaataagggttcaaaagggtcttacaactgaactccagtgtacagtctgcacagacactaggcttgtgcaaatatgacacagcgaggccccaggacccttaagccagctgaatgtactgagtttcaggaaacagtgagatacattcagcaaaacagtgggcttcatgctgaaagaagtcactccaagtaaacacacatcacacacacacacacacacacacacacacacacatacacacacccgcagacaccctagtggccaataggtcctctcaccaaaaacctgtgatcaggagagcagaaagcctcccaggggtccatcactgccctttctggagccccttatcagatggccagccccaggacagcactgtctgatcctggtccagtccaaaccgccatcaccctgtgatgtgggagctggccacttcaccagaacctctgtgtcagaaaaatttctcttccttttaaaatgatgagggggaaccttcagacagtgtctgattagggtgggtggagagaggggcttcctagaaagtcaggcagggcagggctgaagccctctgggttaactgtgtgcttttgatatgaagtcaggtaagactggacaggtgggcgtgttagtgaggggatggtgtagggtgtgctgaagaactccacttgagctctgcacaccagggaaaatgaccataaaacatcccatcttcactgctcagagaaggctagatctgctgtgagctagaaagccatgtgggggcagctgatgagtcatcaaatgggagaaatctgagagccatgtgttccacaggcctctggtccttgttcaggcagcagggcactgtgacatgtggctccttggccccttccagccaccaccttgattgcatgctgcagggaaagagactgaagaccaagaatggggtcttgctcaccatgggatgatggctcagtacagagctgagctatgtatggcccaagaggcagaatgtggggatgacccaggctgagctgggggatccaactgaacatgcacttgctaagaagctgtgggctatgatgccttgggaccccagtctgggtctagaattgtagcaaaacaggctactggtaaaagttcttgggaagccaactcacttttgctgtcatccatgggcaaacaaaccaagccccaccacttcccactccctctgaaagcctcctgcccctctgatcgaccacaccacaatggtgtcactctgtaaggcacaggtagacaaggcatccagccatgaacactccagggcgcacacatgtccagaatacactggttcttgttgagactccactcttccaactcagacagaagctccccaatctcctcagccactcccaacaactggaggtctgaaaactttcatgcatgccgctatggtctaaaccactcgtggcggttttcattttcattttcctgataatcagtgatgctgagcacctttccataatgccttttcaccaactggatgccttctatggctaaatgtctattcaaatccattgcccatttacaaatctgcttttttgtgggcttctttttttctctttttttttcctatttatttatacaagttccttaggtattttggatattttttaaaatgattttcaattccactgcccagttataattttttttttttttttttttttgagacggagttttgctgttattgcccaggctagagtgcaatggtgcgatcttggctcacagcaacctccacctcccagagtcaggcaattctcctgcctcagcctcctgagtagctgggattacaggcatgtgccaccatgcccggctaatttttgtatttttagtagagatgggttttttccatgttggtcaggctggtctcaaactcccagtctcaggtgatccatccacctcggcctcccaaagtgctgggattacaggcgtgagccactgtgcctggccaattatcccttttagtgtttttttggggggttgggggaagaacagagactcactctgtcacctaggctggagtgcactggtatgatctcggctcactgcagcctccgcctcccaggttccagcgattctccggactcagtctcccgggtagctaagatcatgggcacgcaacacatgcccagctaatttttgtatttttagtagagacagggtttcaccatgttggccaggctgttctcaaactcctgacctcaggtgatccgcccacctcggtctcccaaagtgttgggattacaggcgggagccaccactcccggccccattttgtgttttaacatcagtcgacactcgtattttaaaataacaacaatgaatggcggtaccttagaacaaaggaattatagatctttctcttgtcctagtgcagacattttgtctataaaatgttattcacagatgaattcatgagaacattactgtgaattttacatccatatacaagtgtatgctcattcatgaatatttcaataaaataaaactaatagcaaaaaagaattccagagttgaagcagtttcaggaaaaaggagttggcagtatgaagtaaaatagcaaaaaaaatgtttttttaaatgggtatatttgtgtctacaacttttttttaattatagcattagacaatgtgtatatatatacgtatataaagcaatggaagtagcattgttttcatactagtctagaatattaaaatatatgtaatatgtgatcagcaaaataatggccccccaaagatgtccacagattcctagaaccttacatgaaaacggtacatcatgcatgtgattcaggtaaagaccttgacatgaggagactaccctggtgctatggaatgaatgttgtgttccgtcaatgttcatgtgttaaaatcctaaccctcaaggtgatggtattaggaggttaagccttacgggagactctgccctcatgactgggattagtaccttattaaaggcacaagggagcttgtttgttcctctcaccatgcgaagacacagcaaggaggaagcctctatgagaaagcaggccttcaccagacaccaagactgccagcaccttgatcttgcacttctcagcctccaggactgtgagaaacaaagttctgttatttataagctacctggtctaatgcatttccttgtagcagcctgtacggattcggacagtgggctcatgtggatgatgacggtgtctccattcaggactaagtaagcacatgagtccttaacagtggaagagaagggggaaggaaagagccacagagacatgtggccatagaagaagggcccatgggatgcaaggttgctaatggtgagagtggagaagagcccaatgccaaaaaatgcaggcagactccagaatgtggaaaaggcgagaaaaaagatcccctagagcctctagagatgaaggtagcctttccaccacctagattttagcccagtgagatccacatcacactctgacatacaggagtgtaataaatttgttttatgccctgacatactggtagtttgttgtagcagcaatggactagtaatatataaatatatacacacacacacacacacacacacacacaaacactacccccccaccacacacaacataactatctatatatatcctgcccttcaaaactgaatcagataaactacacattagcattaacttagctgggtgtggtggcacatgcctgtagtcccagctacacaggacgctgagagggaggatcacttgagcccaggagtttaagatcagcctgggcaaacacactgaggccacatttcaaaaacaaacaaacaaaaaacacaacaaatctttgattaagctcatttcccaaatttgaagaggaaacaattattagataaagaggagaaaagagaaaggtagagctgctgacttctgtggtggaagcacagacacaggcccaaacatactcctgtcctcctggctttcctgtcccttctcataagggacacaggaacctctcaaactgaaccatggatcacagaaccatactcagaacgcaatacagttttgtctacaattttttatatatctgtgtccctgtctctgcctcccattcccaactcccttactcttgttagaaaaaaatggctattatcaaatatgagtacatccttatatactaatgccaactgatcaccagctggttttcttcttttacaaagtcataaatatttaggctttaacacatcttccaagcaatagaatgttattttccagttcattaacacaaattctatatctaaaatgaagacttcacaagttgatttaaataacatattaacgaaaatcgactggccatggttcaaactgacattttaattaaatgtgatgataggttgagcaacctagcagtactctaaaatgacttttggttatggctttttccatattatgtttaggctgaggcatccctaaatgattcaattgtaattccccttcttaaacatgagatttatctttacaaaataatttattttcttaaaattgcaagttaattctatagttcatgcatacataatctcagtagatatcagctgtatgtgtacacacatacatataggtatttgtatatacacacattacataattaaaaaaaaaacttattagcagggtacaaccacgaagacaaagaggctttgtgtaatgtgatggaaacacaattgcaggacaaacaacaggctgctgtgagggctgtatttaccctttctgatgtaagacttggaaaaacatggatactggatatttaatccccataacagaaaatttagggtgcagacaacttcccacaatttttacagacaatgtcaatagaaatgcattcaatgcagggaatacacagtgtgacagtatacaaaaataagcaggttgatggtttagatttatgagacaagagaaagaaatagtagatgatgtcataattctccttttatggagttatgaaagttcttcattttatataaggtcaggtgctttcaaatgtcaatgagaaaaatatttaaaggaagaatcaaatctaagatgtagagagatctttataaacgtgaacttcaggccaggcacggtggctcatacctgtaatcccagcattttgggaggcctaggtgggccgatcacgaggtcaggggatcaagaccatcctggcccacatggtgaaaccccgtatctactaaaatacaaaaaatcagccaggagtggtgacgtgtgcctgtagtcccagctactcaggaggctgaggcaggagaatcgcttgaacccaggaggcagaggttgcagtgagccgagatagcgctactgcactccagtctggtgacagagcaagactccatctcaaaaaaaaaaaacaactttttttcatgctgagaagatataatcatcaacacattcttgagcacaactatgcacacaggcacttccgcattcacaagccatgctgtgtgcacacactgatgcccctagattccttttttgaagagatggtctcttggtgtgtcacccaggctggagaggagtgttaggatcatagctcactgcagcctcaaactcctgggttcaagtgatcctcctacctcaggctcctgagtagcctgaactataggaatgagccaccatgcccagccaatgttttcattttattgtagagatgaaatcttgctatgttccccaggtgggtcttgaactcttggcctcaaggaatcctcctgccttgccctcccaacatgctgagattacaggtgtgaaccattgtgcccagccaccggattctttattaagaagaaaacttgtttgctgacatgtaggcaatgaattgatgaatagtagttcataaattactaatttacaagtcaatataaatgagttgagtaaacacaaaataacagcataaattaatgaacagtttacgacctcaagtttctttttttcctttaaaacattgctctgacagagactactacttgtccattccatggaaaagtcagaggtggttaaaatgtcagaggtacacttattaacaccttgctgccttttgtgtagcttcctctcagtacttcaccagttgggattgacacacctctccagctgggttcaggagccagacaggagcacacagaacagggaatccaaagccatctctgacaccaaaagcaatgaaaacaaaaataaccaaacatattatcaagaaatgaacaagagatcgatatcaagtacagcaaaaagagaagaaatcacttaatctgccaggctttcattctgacaaaataatttacaacacgcatgtctctatctgacatgtgtgaatagaaaaagaagaggtgacaatagagtagaggattcgtcttccaattgtctctgatctatccaacctttgttacacatcagagagttctccaatttataaataaacaacagagatatgtggcaaccaggacacagagacatactgagagtactgctcagctctctgcctaggcctgattctgatgatccctgacaatgagcactgtgaaatttacagcaaatcagtacacatacacacaaacacacaaaagagatacttcatgggcaaaaagcaccaaagatataaaataaaatgcctgaaagaccataaaacaacttctgatgaaatgctgttttcattttgcagtagtaaaatattcaccaccaaatctacaattagcttaaaaattacaataagtacagtacttttggatcccatctccaattcacaccttatcaacatgtaataatcacactgcatctacaacaaagctggatggactttatgtgctgaatacaacttgcacactaagaaggaaatttgttgaaataatgagaatccaaaatttgtatgccatgctctacttcacaagttaaaagaaaatacaatcatttctatttttaaaatgcattgaaataaaatacagaaaatacagtattctaataccagttaacattaagagaatatatctctaaaccaaagatcttggatcttctagaaacaaaatcagctggtatatatttggataagaaaaaaaaattaagagatcaagaaaggagagaagacgttcgcacagaatcatctccaaaaatggctttctgacgcattcgaccagttttcaagtctatttgtttttcctcctttggcatcaacagcctatatcaccaaggatatgcaaaataattcaatttgtacattaatcagctaatctagaagtggcaatatagtcaatgaaaatacaaagaaacagaaaatgtcaatgaattgcttaagatgtttaagatgacatagcgtagggaaaaaatgatctgataaacaccggaagagttaataaggaaactgaggcatggttccctaacaccacacttcaaaagaacttatagagagaataaaggaataacccttaaaaaaaaaaatctaattttagaaaaaaattgctcaaaagggaagttagggttttatagatcttctggaaagctgattaatttctaagctaaaaaaactatatgaagctttttaacgtagcacaatagataaaagtatgaaaacataaattagaaaaaactaaaaatcataccataagggatggataagttagaatacaggaataacaggccaggcatagtggctcacatatgtaatcccaggattttgggaggccaagtcgggaggattgcttgagcccaggagttcgagaccagcctaggcaacatagtgagaactcgtccctagaacagaacaaaaaaaattagccgggagtggcggtgcactcctgtagtcctagctacttgcggggctgaagcaggaggatcacttgagcctgggagttcaaggctgcagtgagccaagatcacgccactgcactccagcctgggagacaaagtgagaccttatctcaaaacaaaaacaaaaacaaaaacaaagaaaccacaataacaaaaaaacactggtaacaataaaatcatgattacataaagactgtatagaaaaaaaatcctcagaatatagaaataaaattacgtattttacctgtagctatattagaagagagtattcttgtagacaaggatgtctagaaggatacgcaaaaatgaaaacagctaataacactcattatgtcaggcactgtggtaggtagtttatgcacattgtaacaaattatatactacactatctcaaaattttcagataaattttactggaagtcataaatcaatacaacaaaatcagtgttttgcaaacatccactaagcataaaggtatacaaattcccaacccagactgaaaaataattcacataagccacacattagtggaaacctacccatgggagataatacaacataatctaaataaaactttcagagacaaggcatgtggcttctggacagccacaaactccctgactctgctctagtgtttcggccatcaaaagaaagccaagtggcctcaggtctctgaaaaaccaaaaaagcaacctatggaagatggcgtggtatttgaggaatatttgaagtctgttgaaaaatgcatcctgtatttttttcaagataagactcccttgtaatgtcaggtaagtgaagagccctcagagacacatgcacacacaaagaaaaacaaaacgacatagaatgaatcccaccaaaatgtgttatgatggcagaattatgggtgatatgatcttctgtaatatatctttttattaaaaatagaaaaaaagcagacttacccttgattatctatagcctctgacccaagtggtttggaattggaaagcagcatcactcgacttgaagccatcttggcatcaatggtggagtaggtggagatgagactctggaccagctcatgggtgagccccaccttgtcctatcaaggccaccaagaaagggcacgtgaggaaagcacaaagatcctggagagacactggtttcactcagtttctcaaaattatcttagacacatttcctgagaacctttcttaatgccgcaaacaccagagaagaaaatccttataacaaagcttgaaatggatccccatctccattaaacttttccaaagctcagtgagtatataacctgataacctaaacacctagctagaaaaacctcagttccagtgctacaacagtgctagcttttctaacatttttaagtaaccctgcttttaacccaataaaattcaactacagaactaagaaataaatattggaaatccactttaaaacaatgaggagaccactgtgattgagaaaaagaaaaagacaaacgagagctggaaagcacactgattttgtagaaacggaaataagccgtgcaggtgccacactggcagcagtgcccgcgctggggccacggatcaaggaggcatggaggacaggactcttctgcttggtacaatgaaaaaatggtattatttttattctacatattgacaatatgcatttgggcctttattataagtacaagagaaaaatcttcaataaataaaagctgagtacattactttttttgattaagaaatagattaggaaagaataatgagagttcagagcaaagactcctgcctcactgatgcctgaaaaccgtggctgccaccaaggtcaacacagacagcgtctttgtcatacagcacaccctcaactccagaaacaggcgcataaaccagctgctccttcttatttaaacagcacttcttttgttattcaggaagaacacaagggtctgggaggaaactgatgtcactcatggcaaaatgttctacccctggaagacaggacccaaaaagccagcttcaactgacaagaagtcagtaagtatctactgttgactggggggttaaaaacgatccacagtccaagggcttaacccatgaccctaaagaagggcattgtgccacactggaacagtgaccctctagctacaagaggtcagagaagagggattcggtaacacctttgcaggcctacacatagctggcttacttttaaaacctccagcaaggccatcttcccttgtttggtcatttttcacttttcctgagaaatgaagccatcccaagaatcctatgtgcaattctcgtatgttctacagcaagagaatacctggcatgtgaatttggcttttatttttcaagtgtgctcctcttaaataaccataaagtgacacctgcaggtcacatttgatgtttgtttggatatcctccgggtttgtcaaatcttccatcctagaaaaataaactcaatcatacagcagaaatgaatgccaaagttcctatacctcctttcatgtgtcaatgactcatcacactcttgtccattaagcacatcacttaggaactagaaaatgcagaaataaggaagcaccgttcaccatccagaagaggaaaaggggcaggcacacaactgtgtctctaggctgaaagtgacattcattccataagacaccagatgggagatggcgtccacctggggtcagggaagagtgaagaacacattcagaaaatccatttctcgaagagggtgagcctgtgctctgggatttgtactgtggcttggattctggcaggtggaaaaagggtattccaggctgagaaaatcacagcacaaagaagagcacaaaggaaggaaactgaaggcatgcacgaaggactccagcacccgggcacgaaggcagcatcactgaaaactgaggctgaacgtaggatggggccacatcctgtagtcttaaatgcttccaagtcctcccattttcctaaacatctcataattaatttactcccaaaggcacagcatctttgagcaatgatataagtagacattttccatcaactacacttctacccccactattcaaataggcacaaaataaatcctatcactgttctttttctagcctttttagctttgaaatatatggcccaggaagaaaaagtttacaatcaccttttaactgtctgccaggatataagggtgaaaagtttgccatgagaggcctaaacttcataactgtaataaaatggcccagattgtggatttcttggttttgatattctccatgcaccattccagaaaggtagaacagtttggcaacctaaacattaaaggaaaattaaaaattaaatttcaattaaattctcgtcaatactgcaacaaaataaaagctctaaacaagaagcaatcctaagaagggagacttccagcaaagccactgtcctgaggcttccagagccttgctggattctttcaggacttattagaaccacacagaggcagactgctctgcaaccaagccggggcatccatctaagtatggtgaggagagggaggtgaggcctctgagcacagaaacggttctgtggccgatggaccacagcagtatggaaaggaaggggcagtgcctggtcctgtaactgggagaaacttctgatgtactctattaagtcccgactccaaaacacccagacattgcctggtgcagcaggtacggagacaaatgagatacaccaagaggcccagaataaccactctcttgagggaaaccttccagagactgggaacacatacacaaagggaattcaggaggcaattcctagagagacgtttagtaatgtctcttcagtctttttgtttgtttgtttgtttgagatggagtctcactctgtcacccaggctggagtgcagtggtgcactctcagctcactccaccctctgcctcccagctttgagcaattctcacgtctcagcctccctaatagctgggattacagatgcatgccaccacacccgactaatttttgccttttgagtagagacagggtttggccatattgccctgagctcaaaactcctggcctcaagtgatccacctgactctgcctcccaaagtgctgggattacaggcgtgagccactgtgcctggcctctttagtctgtttttaaaggattatactgttagtttctaacaattatttctcttcctacctggtaaacttctgtccagaacctgtgttttaatcacttctttgtcttcttcagttgcttgttatgcttgaaggagtcgaggtgggtgagaactcccagaattttaggaaagccatgtgcttgacagatgtttagaaactcaaacatttccatttcaaacccaaagctggcatctataagcatcagtacctacaagcacaacacattatttctcgaagaaactaccaaaacagaccacctacactaggggttggcaactggcccacgggccaaatccagcccatcacctgtgtttgtaactaaagttttattggaacatagccacattaattcatttacatattgtctatggccgcctgtgcactacaactgcagagctaagtagctgcagaagatatgatccacaaagctgaaaatattcactatctggccctcaacagaaaagtcccactccagactaaatcaaatgactacacaggcatcacccagacagagaaaccaccaccctctgacttgctctaaaaggcaaccataagacaaggccactaggatataaacatccattttaagaattctaatgcatgagaagtaactcagaaaaggctgggtctaacctggcccttacctaagaaatcctaatttaaagaaatgaagttttctgtaatgtatttttaagccaaataacaggtctctgacatccaaagaatgggaagaaagtgataatcaatgaaatatattaaatacgtacagaaaaccaacctcttctttcaatctcctcacagaaaaaaaaaaaaaaaaaatctgtttttttgctgggaagtatacaatggaaacctctaacttgtatgttaatttgtataactcaattgctcagaaatatttgaaatagctaccagtttagaattaagtaaaaaaacagaaagattatgatgaatggtagtctataagaaaatataagcagataagaccaatttttttttttttttttttttttgagacagagtctcgctctgttgcccaggctggagtgcagtggcttgatctcggctcagcgcaagctccgccccccggattcatgccattcttctgcctcagcctcctgagtagctgggactacaggcacccaccaccacacccggctagtttttttgtatttttttagtagagacggggtttcacagtgttcaccaggatggtctcgatctcctgaccccgtgatctgcctgccttggcctccgaagtgctgggattacaggcgtgagccaccgcacctggccaagaccaatttttaaaatttaagacacttcaaagatgcaaaataatttcagaactgattcctggaaacttgtaattttaatattaaagatagttctgtttgtatctttccatggataactaaaaataacacaaaatggaaacagaaatgcccatccttgattaaactaggaaacattcaaaacccaaaaccacagaatatatgaagttgggcttgtaggaaagcacagctgccactgcagaccaaggcagcaagcagagctctccagcaacactggaccagctcaaagaacaggtggaatatcctcacaccacatctgatgccagagtgccaagggacaagcagctggttgtagggtcaggaataaaagggagcaaacagtccctcagctgccaatctttgccatctaagccagtgtcactcccctaatccacacacgcacgtacacacccaaatccacgtattgtgtgtgcctctgctgtactcaggaggctttgacaacccagagcagagcaatcaacataagctagactaaataaattatggtgcatccacagaatggaatgttatattaaaaagaaggaggcagagctacagtacttactgattatataccttcaagtatattacatgaaaagagcaaagcatagaacagtgtataaaataagctaccgtttgtgtttttaaagggtggcatgtgtgtttatatgtatctggaaggatatacatatacatatacatatatataaaggtctgcagggacctgagagaccagaggttacagcaaggaaagagaaaatgcgcattgtgtgtaccgtgcattacagttagagtgctttaccaaatgtgtgtgctccttttgaaaatcttaagatttacataggcatctctctcaatgatggttaagaggctgggaaggggagcagggagggagggacaaagagggaaaggttaacaggcacaaaaacacagttagatagaataaattctagtgtccaacagcacaatagggtgactataatttattatataattcagaataactaaaagaatgaaattaaaatgttcctaacacaaataaatgataaatgtttgaagtgacagatctctgaattaccctgatttgatcatcacacattgtatgcttctatcaaaatactacatgtaccccataaatatgtacaactattatgtatccataataactaaaaataaaaaaatgtaaatgcatctcttaatatgtatgtatttaaaattagaaacttgctacattttaaataaaagagaaacaaatgacttctatgaactattcaatcatttcaagtatacaagtttagtaatcgttacacaactttacattaattacacttatttttactaatagtagcattacatgttcaaaatttgaatgttatttagttttctgacattacaatggcacaactttaaaatctgtattactttttcctttatattttaggagtcttcctaggccaaagtataaaatctgtagctctagaaaaaactaaataaaaatgaaaaaaacaaggtatctgtcaccccacacttcctaatcaatatggcttatttttttgctaattttttttttttttgagacagaatttcactcttgttgcccaggctagagtgcaatggcgtgatctcgcctcaccgcaacctccatctcctgggttgaagcgattctcctgcctcagcctcctaagtaactgggattacaggcatgcaccacctcacccggctaattttgtatttttagtagagacggggtttctgcatgttggtcaggctggtctcaaactcccgacctcaggtgattcgcccactacggtctcccaaagtgctgggattacaggcatgagccactgtgcctggcctttttttttttttttttttttgccaatgtaaaagatagttcatagaatatcagaaatagtgaacattatcatttccataaatgcaagagcatgtacattttccacacgctgagtactgcctgaattttctattgataaactctgaccacttcttcaggcaattcatgtacttactttagcattatcattaaggatgaaggttctagaaccatcaggaacaagggtcccatcttcacacaagttacttaactgctgggaggctctatttcatcttatgtaaactatagataatacctactcacctcaagggtgtatgtaagctaaatttgtagaaagcagttagcacagtgccaggaagggtccaagaagaaatggtacttactatgatatatttgtacatatatatgtatgcatgtaaatgagctcttattagctgtgttcattaaaggttttctccgtcctgtgatctgcttttagattttggaacacatttcattgtgcacattccatttgtattattaatatgacaacatttattactattattattatcatcatcaattcaatcacatctactatatccctgataatgaccatgatccttttaataatcacaaaactctcttcccttcatcacggggtaaataacctatcacaatgctgtaagtctccatcagcaccccaggctgcccctgctcacttaccagatctgctactttagccagatcaatcatcatgttaatgtcacacccacattcaataatggtgagtctgcgctttttacctataagtgaaaagatgaaaattttactttaaaaagaccctgaaaaaactctaaccatcaactcttaattttcattttttaactgcatccagtaaaacaccacatacgtttacaggagtgtaccagaagttcatttttataggcaaaaactggtaaaataaattccatcctgtttttcttcctgtgttctaaatttagataatatcaaaagcctacccagatgaataaaagtgctcaaaacagggaaaattctgactagacaggctccacgataaccatgatcttgctgttcagctgcaggccaatgtcttcacctctatcaaaatttcctgtattcccactatcgctaaaaacatcctcaaacataatgcaacagaatatttacaatgataattatttctaaattaaggtaataagaaaatgatcaagaaaatattggctgggcacagtggctcatgcctgtagtcctggcaccttgggagaccagggcaggtggatcccttgagcccaggagttttgagactagcctgggccacatggggaaatcccatctctacaaaaacataaaaattaaaaaaaaggaaaaaaaagaaaaattagccaggcatggtggcatacactactcacaggaggctaaggtaggaggattgcttgagcctgggaggttgaggctgcagtgagctgtaatcacaccactgcattccagcctgtgccacagagcaagactctgtctcaaaaaaaggaaaataaaatatggatgcgccaaagataaagaaaagcctcaatccaactatattactgcaataataagagatttcagagtgtacattgccattctaccactggatgtttgtttcatcttccctcaaacttggaaaggtcaccatctcccaaagcagacaaattctcataggaaaaagagaaaacgcgcacttccaccagcatgtggcttcataagggcaagcatgtgcacctggcacataggaggtacgtgctgtctgttaaatggtgtgttcgcagtgaccaggcctgtcaggcccttccaaggaacatgcttggcaaagccatagagcagtcaggataaggtatgtatcacatccttatctctgggaacttatccttttatgaagttatagctaacttagtaaaagtaagagagaggtaacatgatatgacaatatttaacatgttccactcaagaaaacaacaaacacacgcatgtccctcagatgacaacagccacgccaagtctgtgtctgtggcggcatctcctacctgacacgatcgtcacagggcctctgatctcggtgaacttctgccaggtgaagttccgaatgaggcattatatcaaagtgctctttccaactttggaggccccgtcaccactaccgctattggtggcggctctagtggagttccatcaaccactggaatatgatgcttttgtgtcttcaaatccagagtcctatttatttaaaaaagaaaaaaaaagtaaactcacttttaaaatagagtaaaaggtatcaaccttataagtagacttttttttagtataattacagatatgagtactttagtatattttatagagagtacaacagacaatataaaaatataagtaacttgtcaattattaacttctgacccctatccaaatcaattgctgttcaataaagatgtaacaagatgacttcaatagtatagagttgaaaattaaacactccttaaatctgactgttttatgagtgatttttatagttttttaaaaaccaaaaggtaaatactgaggcagcgcatcataacagataagagcagaggttctggagttaaatttggctctccgacttactggttgtatgattggaggtaacttgttttcttgacctcagttttcttgtccataaaatgagggcaagaatgattcctactctggtaaggctgctggaaggatttagttgaataacgtttaaagtacactgctaagaatatcataaggactcactaaataaaactatgttagtattacatattgtaatttttgtattttatattacaactttgtaaaacatatccagagggaaaaagcacacttatcaccatagaaacagtttaaagtttaggaagaatcaaattctataaattcttgtatcttgggcaagaaacaccaaccagtgtgcagatgctggaggcaaggcagcttctatggcaagtcttctcacgttttagtaaaagccacacagcatgcatctccatgtcctttggagctggactagacttgtgaatccaaatgtcacctgtgagaggctcctaactatttaaaaagattcaatggaagaaccatcagactgtagctaaacacacctgtgaaaggatcgagacatccacacagcagactgaactgcaaaagcattggcatttctcttctgggcattttcttcgtctcctagctggagatcctgcagatgccacttctttttctttgcagctttgggtccactgtttttctttctgtgtttcttctggtccttagtctccatagtggctatttaccaataacaagtaactctaacctacaaggaagaaggttggggtaaggaggtgggagaagcattttacaatccaggcaatacccagggaaaaacattaaatttcatttatttctttatgaagacatgatgtatttgttcactgaacaagggtagaaactgcttaaccatccccaatttcatttctctctgttatgctataaattagatgagttacctctgctaaggttacattctatggttaagttactttttactcgtctcaagtgtcaacatcaccagtacctatttctgcaaggatggaaatattctatatctgtacttttcagccatttagccattagccacatgtggttacttaaaatgtacttcagagaaactgaaaaaatgaattcttaattaatttcattctaactctaaatagtcacatgtggctaccatactggacagctcagacctagacatcgactggactaacgaagtggtttcctaacttaaactaaaacttaaatttcaataaaaaatttaaaacgtttttatgaacttccaataggatcgcagtattacttttagtacctgttgactctaaaacttctaaattacagctcatctacatacatttgaaaaatagcaatatctgtatgtgtgagatatgactggttctagatgatgcctggaggccccatggacttacagagacccttccagtgatttctgaggtacctgggaatctgtggccaataaattggtagtcactgaatctgtgagtttttttggaatatcgggctgcataaaatctgacagcttgattgagaaaaagcggggcagggtgccatttcattcagttaaggtcctgtattcattccgtttaataaacgtttgtgtctgtctatgatgtgctagccactgtgccagaaaatggatatagctatggtctgattgacagaggaaatccaaactagtatcttccgtgccatgcaataagagctacattgcaaggctgcagagggtgctactggagcacagaagtgagtcaaaggcttcccacagacacacacacgagcggaaacagaaagtctttatatatcaccatatgtcaaggaacactggccgggagttaggagagctgggcactaggaacgctttgaaactgaatagctgtgtgatttcagaggttatattgcttgtctactatattttactgccgaacttgtactgtttctctcccttttcttcttggtgggaaaagcacaatttggggtcaacagattcggctcaggtctaagtcgcctgccgggaccacgtcgccaggaaacgacgtctccccgacaccttccctcccagtccgggctctctgcagggattcatcccgtcactctcccaacgaccctcgggcacacctcaggcagatgcgaaatatgccgctcctggggagcaaagatgacccggaggaccgggggagtaccttcccacgcgcacgactcgcgatcttcccagtgccccagagccacggacccaaccgccgcctaccccagcccgcggcacctaacctgttcacaactgcgactccttaggtccgcttggacaccgccggaaacggaaattcaccctcgcgccgactcgccggaggtaaacaaaaaggcagaaaaaaagggaccgccgcctggacgacttgcaggggacagctggaagaaagactcgtcaacggccgagtgctggcgccggcgccgtctgcgcagtgcgttccaccgggtccgcgtccctcccgattcagccccaccccgccctcggaatccgctgcctcagctcctgctgtggcactccccagcagcttgcacctcgctcgcggagtccttgctgaaggccagggcagctgtgcggcctggcgcgggttacttgatgccgtgcaaaagccaggagacacatttggttctggccgccccggagtcaccgtgcccggggcgaatggactatggctggattgggagaccacttcctcctctgtaaagatgacagacgagggagatctcacgttctgggggtgccctatagccctcttttggccagaagcggtggatcacgcctgtaatcccagccctttgggaggccgaggtaggaggattgcttgagcccaggagttcaagaccaatctgggcaacatagggaggctacgtctctcaaaaaataaataaatacataaataaataaaaataaagccagcgtcgtggcggggcgcctgtggtccctgtggtcccagctactctggaggctgaggcgggacgatcgcttgagcctgggaggcagaagttgtagtgagctgagatcgagccactgcactccagcctgggcgacagagcaagacactgtctcaaagaaaaataaataaataaaataaggccctctttttccgggaccaacagactctgagggcagggacaaactgacccagcctaaactgcctcgccttccctgctcccgggaaaggggttttccctgagggaaggtagcatcttgccattttcttcctgcacagctttgccttcccagggatccacccattgccacctgaggaaatgccttggagcccatctaatccccagcccagctacttgggacgcctacagagactacattgtcagaggatgcatcttcctctagtcttggagggtttcttttcaatatgatcccaccggtgcatgcaaggctcaattctacatcaaaaaactaggcccactcctgtcgccgagacccccaggcttcaggtcctgtcacagtgaccttgttatcacccccagcagcccccaggtattcactctgcataggctatatactgggtgctgcactagggaggctacctacgtggcgcatgcttcccttatccctgaagagcttaggatgttgtaacttcttcacactaggcctcttacttcttggagatgtcagtatctgggtaaataatccttctaacatccttttggtcttatgaagcccattcttgtcctctgccctacctcagcttccccctccctccatgatcagaccttagaccttgtcaggtccaaggactgcaaccctcacagtatcccactctgaccaccacctcctatctagagcaatggagagactttgtaggtgaaagctgtctttgctactggttctcctatgctccctcgcctggctcctgcaggcggttgacttcaccagggacacagtggccagtgcccagcaggtcccactcctctcaccagctccaggcagttttattgtagagtaactcttctgagacaccgctcctttccccagcacctaaggaagtatttctagtaagttccagtggtatagcatcggtgactctcccgacaagcagagggccatggctgggttcctctgatgaggtgcaggggcagggcactaagaggggaggactctcctgagttctctacctgagccctagactagtagctgctcctcctatacttcctactagtctgtgcctggttactccacttccctgttgcaattaacaattccctatgtacacttttcctgttcaaatgactgtgtggcttctctttcctaatcggactctgaccaatacgctatcatttgccaacaactcccaaagttttatcagtgactcagacctctaacctgaactccagctgcctccatgagatatccatttggatgtttaatggacatttccaaagtgatatgccctacagaactcagaatcttccctctcaaaccaactgctcagcagtcttatgatcttagttgatggcaattcagaagtgaattgcaggacacccggtttgtatctgcagagagaactggagaactgcttagtgtggaaaacccacacatttggtttcagaagtgtgtgagtagaaacagttttccttttatgtttgttggatggataatgatgaacctagcaggacacagaaagctaggcagcagtggaactgagaatgaagttatagttaatagcagagaatgaaaaagaaaagacagataaaacattttgaagaaaggacagtaatgtattcccaacaggtaggatttacaggatggagagaagaggcaaagataactacaaaatttctagcctgagagactggtagaaaaaaatggtggtatcaggaacagacaggggttattaagaaaaaggattggatttttaaaataaagaagatctggtgtaaaattatcctcaggaaaactggaaaactaggcatgtacttctctccatcatgcccttgcacagtgcagtccttctgcctgtccatgcctcgcctccccctccctaggattcctcttcctctcttaagacccatctcaaatatcacctagacttgtaagtaatttacatgaaactggatacctgaggtatccctttgaaagtttttaataacaagttactgttatcttttactaagtccaactttatattcgccattttaactagcatcatttctgtttccaagaggtatttggtgtgaaagtgcaactaagtttactgttaatcaagatcagaataaaagaatctaccaaaaaaattaacaagatcccccttttaatgcataatctttcatccatcaggctgtaagttaaatacctaacataaaagaaagctgtatgttttatggatatgtacatatataactgcagggaatatgatttggaaggatgtacacttagagaagactggagtcacaagtggtagtcaagggagtcttcagatttctttttgtatttcaattttgagagaaatacatacatatgtattataattttaaatttttaatgaaaaaaagtatttttccttttttttcttgatctgtcactacattatatttttccaatatcagctaaacatttgcttcccagaaagcttagttgtcttttcaaaatttattcaggttaaaataaaagatttagacaatgaattaaaaatctaagatggtatttgcctactttatacagaacagtacattgatgctgctaaagcaattaaagtataatttttctttttttttttttttttttttttgagatggagtctcactctgtcacccaggctgaagtgcagtggtgcaatctcagctcattgcaacctctgtctcctgggttcaagcaattctcctgcctcagcctccccagtagctgggatttcaggcgtgcaccaccacgcccagctaatttttttgtatgtttagtagagacagggtttcaccatgttggccaggctggtctcgaactcctgacctcaaatgatctgcccgcctcagcctcccaaagtgctgggattacaggcatgagccaccacacccagcctaaagtgtgtactttttcttagctcctatatgcagtgctccttccccatactgaatgtctgaatttttatctgagacatagtatttcagatggtcattacttacgggtggtcattaatagttcctccctgcttctaaccttcctctcctcattttaaattaaattacgctacattattgtggattagaaagtacattaatattaagtgaaaaaatatgatctgatgagtaagtggcaagagtgttaacgtatgaatattaagagttgttctgaggcctttttgcttttctgggggttctgtgcttgtggtagaactcttggttattttataaatagttcctgaaaagtgagagagtacagctggaaatcagatttctgatgaataaatcaaaccctattaagagaaacaggttcaagtaattttaaaaccatttgaattttcataaatgttttgttaatgattaattataaaaaaaaacagtgactctagctggaggcttttgtgtgtttgcttttgagtcagctaggaaaaggaagaaaaattcaagcttagtcaattgtggttttcactgaatcttttttaaagtaatgagctggtttgttttcttcatcactatagcaacttaagctagtttttgcttttgatttttatttctcctagagaaacttagcatgcactgctcattagacttgggcatactaaggaatatctgtggtaattaagttaaaaatcagatcagtgctttgtgctgtgtatagttgcagatgtctgcatttcactaatattctttggaaacatctggataccagttaacataaaataactgtttagttggtttctgttcagaatagaaggaatgacttaaaagttcccattgtagtacatacgtcattctatccctagcccttcctccagctttactgagattgataaataataaacatcatgggtggtgtgtctttagtttcctctggtgagctggatgcacagattactttgtcagcagggtggtcttgatttttaggccatgtgtctaatggcatcagctctgtggccgacacctgtgtaccaagcccattcactatctagcttagccagccgtggactcctgctctttgttaaaagtatttaccttcattcctactagcacagttgaccaaagacccagttgatcccaaacactagtaatgcatcaatggagtctaacagagttttaagatgtgtgtgtgtgtttgggggtggggggtgtagagatgggatctcactattgttgtccaggctggtcttgcacacctgagctcaagttctcctgcctcagcctcccaatgtgctaggactacaggcatgagccaccatgcctaaccctctaagactttgggatacaaaaacataatttactttccttcatttctggaataaaacatctcttcttcctccccctactttctgttctgtgcccctgtttgatctctgttggtcctgttcaccttcagccttctctgctgaaggaggaaaggcttggttttataaaaagtgacaatattcagaccacataagatccttcttgcttcattttggattaaatattttaagattttctgattttcttgtatgcatatgtatttacctattatttgactttattgaataacttcaaattgagtatatttgaatgggaatgggcattaaaaagtgctaagctttccctgcctttcagaactttgtatgtatatgtcacatcattttgtccttcacattctccagttgtgctaatttttcccaatccattaagtagagtaccttcctttttggagtcttacttttttttttttttttttttttgaggcagagtctcaaaccgtcgcccaggctggaatgcagtagtgcaatctcagctcactgtaacctccgccttagcctcgtgagtagctaggaaatacaggagcatgccaccacacccagctaatttttgtattcttagtaaagatgggggtttcaccatgttggccaagctggtctcgaactcctgacctcaagtgatctgcccagctcggcctcccaaagtgctgggattataggcgtgagccaccacatccggcctccttacttaaatatcttaatgtgccttagaatgtagttaagaattttcaggtgacagtatatttttgatagttatctttggtttccaaacccagagaaggaagagtaactggctttttctctgtgtgggtacattgtgtcttattggagattgttttgtctcaagtattgctgcagactattttattaatgggtgcaactttaaaatttttttttttcagattaacggtttaggtatcccagtactcggtatttgccaatttctagaattaaaaacatgtgtgtatcactggttaactagaaatttaaaatgaaaatgtttcttctttagcccaggcaatatcacttgcattcacttctatcccctccttgtccctactctgttggctccagggcttcttccactaagctggtactttctttatacctcctgtacttccattcactgaacctttattggttcatagcctacagaaaatgcctgtggtgtgagaggtaatttgtgaaactgcttctcttcactgtttagcaggttgagctctctaaatgggtgtagctgggaaagaaaatttaactttacaaacaagaattcctgggttccatccagtggaacatgtcttttgttatacacacacagtttctgactcatatcattccatgacttatgataaaatggacattctgtttacactgttgtgtggaaggaggggtctggttcctaatttttagtaacatctatttctagaatattaggcttgccatttgaatgcttctgtttgatttatgaatatcattggttccagcagtttttagctccctgctaaatgcaagttaaaatttttaagtttctaagttaaaagaaagtaacttttcctccacttaagaaagcaaggaaaattaaaaataatgtagtgatgacttccacaggctctaaaagagcaatgaaaaaagtgatttatgtgtgggagaagaaatactagttcttaattaatacattgttttaccacttcccgtgaatttatgtagaagtaatgaaaccaaggtttaagtcatttgttcaaactcctgtcagtttagactttttaattgctttgttacatgccattgctttgtaatacttgttatagcagtggtaacagttgagatttgcctgtttgaccacttgcagggcaccgtgccagattccccatgtgcaatgttcctcgcagttgtgacgcccatcgtaggagggcggcgttagcacccctccatgcaagcggatggtgcaggctgggtcgcctgggcacagcgcctgactattttcctggcttagtgtagttatcattaaatatgtggtattacttagaagcattttgaataatttgaaaagcacattttagtgttgaaacaatttttttttgagaaaaggtctggctctgttgctggggtggagtgcagtgacctgagcgtagctcactgcagcctgcaactcctgggctcaagcgattctcctgccccagcctcctgagcatctgggactacgggcacatgcccccacacccaactcaattttttttaagatacaaaggattcatcttaatattatttacaatttttttttccttttctgtgggcctcatctgactggaaagcctttcaatttttttattttttaaattgtaaattgacaaattgtagatgtatatttatgaggtacaaagtaattttatgatttatgaatacaacattacataattaagtcaagctgattaacctgttcaccactggaaacaattgcaaatcattatcattttttctggtgagaacatctgaaatttactcagtgattttgaaatgtgcagtactttttgttgttgttgtagaaatgaggtctcactatgttggccaggctggtttcaaactcctgagctcaagtgatcctcccacctcagccttccagtgttgggattacaagcgtgaactaccatgttgggccaaatgtgtaatctattattatttactgtattcaccatgctgtgcaatttatctccaagaaatgtattcctcctgtctaattgaggctttgtgccctttgaccatcatctccccgtcacccccatccccaatgttgtatactgagtcctttcatgatatgtatggaggcttatggtaagttatttaaaagtacatgtatgtcaaaattttttgtggccatagcttttctttctttttaaaattttaagagtcagaatattcgtatattaattcagcatgtatttgagtgcctaatgtatgccattttctatgttaggaaccaggaattaaagcagtgaacataacaaagtctgccctcgtggtgctaacttgccaggtagggaagccagatactaaacacatgtataatgcaaagtcagtaataataaacgatatgaagaaacaagtaaggtaggagaggcaggaaagtgggagtgagaaagaggtgctcttttaaatacagtggtcagggagagcctctcagaatgaagtttttaacagagacctgaatgagatgggggagtcagctatacagatatctgctgtgtgctagaaaaattacctgtaattttgcattctaaaagtttaatgagtacatttatttcacaatttgagaatcaattatatacaagatatagttgtaagcacatactcccctaaatataatttgtttttacagtagaccaaataagtatgttcagcttagaatatgctctttatgatctgtataataaatacattctcttaaaatattattaatattaaggttgatgttttcagaaacatataaaaaagctagcttttaaaattgactagggaagttctctcaaactgccagtccctgagatattgtatattttctatctgaaaaacttttattctcagaattctttaaaagagctgtccctgaggctcccattacttacctgtgactcccagtggaaatcgtacccagcccctcgagaggggctgaatctgttgagagtgggagggtagaaaaaatgctgcagcttcttgtgggtaaacttcacacacaaacacccagtgccccaagcactgtgcagtcaaacatcaaccctgctcagactttcctccttgggattgagaagcaatggattatagagaaagaaaggtggcttagcactccaaaacttggaagggtaattgaccaagaccccccaaagccaaagcagtgggcatccccactttctgtataccctataccaacacgtaatggctactagatacaggggcactagtacctgtctgcttggctacctccccttcttgcagaagtggtgaaggcaatcactcaacctcaggaagggaaaatggctttctcatcttcaaattgaaagaggttggcagtgggtgaggagaataacaagtaaggatctctttcaatatacccatttgaagccaaaacctctgtttagacatacggtattttgaacctggtgactattcattgaccatgtttgtgaattatcagaaagcagaattcttgccaggcatagcggctcatccctgtaatcccagcactttgggaagccaaggtgggaggatcacttgagcccaggagtttgagaccagcctgggcaacatggtgagatcttgactctacaaaaaattcaaacattagctgggcatggtggcatgcacttgtggtcccagctactcaggaggctgaggtgggaggattacctgagcccaggaggttgaagctacagtaagcagtgtctgtgccactacgctcagcctgagcaacagagcaagaccctgtttcccacccctacccaccccctaaaaaagcaagctgaattcttgaactccctgcaaccaggtcacgcaaaccaaaggtaaaaggaacataaaaaagccttctggaaagtgtacagaaattcattgcagggtgatttttgtcttgtgaaatcatagttactgttattagcagcttttttaaatgttttatattcattttttatggtgttctgatgtatgagctgcttcaagtgtttttggacatagcttgggtataaaatgtaaaaagtggatattttcaatttgtagctttcttttttgaaacttactgaaatttgttctaaatatatctccttctttctcacccaccccaacacattttttaaaaaacaccaccaggtatccgttatagcactgatgtgagtgtagatgaagtaaaagctttggcttctctgatgacatacaagtgtgcagtggttggtaggtgatcgcttttcttgctacctaatgagaactctggggaaatatgtttacacacatgttactgttaagatgctatagaaatataccttatcagaactgatttttttttaagttgtactctttaagacctgcatcatttttcaattactctaaattaagatatagcctttttttacgggagggattttttttacgggagggagctaattggattttaagtctagatctttgttttcaattcctcaacatattctataaataagaccaaattatagtagaaggagagtaaataagctattatctttttaaagtggtgaagagcactgattaaatatatattagagccccagcccccgccccagctgcgcgggcccccgcctggcccatggactgcacagcccagcgggcgccttgagcgcggtgcgggtcctcggagcacccccgaggtgagcgcaagcaaggtccggcatcatgtgctaggttattcccagtgcgaggccacacttgggccgtcggagcagcccctcctcacttcaggggtcaccctccccaagacccattgccccatcatggccggggaccggctccccaggaaggtgatggacgccaagaagctggccagcctgctgcggggcgggcctgggggggcctggtcatcgacagtcactccttcctggagtacaacagctggcatgtgctcagctccgtcaacatctgctgctccaagctggtgaagtggcggttgcagaagggcaaggtgaccattgtggagttcatccagccggctgcacgcagccaggtggaggccactgagccacaggacgtggtggtctatgaccagagcacgcggccgcagacagcttcctctccatcctgctgagcaagctggatggctgcttccacagcgtggccggctgcttccacagcatggccatcatcacggggggcttcgccaccttctcctcctgcttccccgacctctgcgagggcgagcctgctgccctgctacccatgagcctctcccagtcctgcctgctcgtgcccagcgtgggcctgaccctcatcctgcctcacctctacctgggctcgcaggaagacgtcctgaacaaggatctgatgacgcagaatggaataagctacgtcctctatgccagcaactcctgccccaagcctgacttcatctaccagagccacttcttgcaggtccccatcaacgacaactactgtgaaaagctgctgccctggctggacaagtccatcgagttcatcgataaagccaagctgtccagctgccaagtcatcgtccaccatctggccggcatctcctgctgtgccactatcgccatcgcctacatcatgaagaccatgggcatgtcctccgaagacgcctacaggtttgtgaaggaccagcgcccgtccatctcgcccaacttcaacttcctgggccagctgctggagtaccagagcagcccgaagctgctggccgccgtgcagggcgacgcgggcaccccctcaggaatgcaggagcctccccccagccctgcggccggggccccactgccatggctgccaccacctacctcagagaccgctgccaccaggagtgcggctgccagggagggcggcccgagcgcgggcaggaagcccccggcgccccccacggccaccagcacgctgcagcagggcctgcgcagcctgcgcctctcctcggaccacctgcaggacaccagccgcctcaagccctccttctctctggacatcaagtcggcctacgcccccagcaggcggcccggcggcccgggcccagcgaccccggcgaggccccgaagctctctgaaagctggacagccagtcggggccatgctgggcctgccctcgccctgcccggacgccgcgcccaggcacacccacggcccggcgcgctatcccgcgcgcggcctgaacttcggctacgcggctgccgggccctggccagccggccagccccggagcctggacgccaccgctcgactccctgaagcgtcctcggtgcttcagccccgagggcgtgcaagggccgggcagggtgctgtttgcgcccttcggccgggcgggcgccccggaacccaacggctgcagcgacctgccacggcgggaggcagcaagggctgagcccgggacgcgcggaccagctggtcagacgagctggccccggattcgcacttcaagtgctgcagctgccagatggagttcgaggagggcatggtggaggggcgcgcgcgcagcgaggagctggccgccctgggcaagcaggggagcttctcgggcagcgtggaggtcatcgagatgtcctgacccctccgctgccctcggctccgccgcccgcagctgggcagttataaatatatattatatataatgcaaagaaaggcaaatggttttactgcgatttttatccagaagtaaatatttcgattttttatttatttaagctgttcattctggcactgatttggcaacagtgcgggtggtcctcgagctctatttttactgtctggtatttaaaccgaaacacgcgtttctaagcaataagaggccaccttcagtcgcaagttgcaggccaggcctggggcccctccctgttcccccgccccaggaaacactgctgacatttgcagaggctgccgagctttcgtgaactttttacacaagagaaagttgaaaaaaaaaaaaactttcttgccacaaaccgagccgcagaaacacccttcttcccccacccaccgcccctgctctctcccttcgggctccgccccaaagccataggctgggggagcaggacctggtgtgccccagagaggtgcggccagccctccaccagctctaggcaccaaatcttggtggcagggagggcaccccgctgcccgttgccccagagctgttccctctcaggggaggacatgcattgggccccatggtgccagggcgttgagaggggctgaggaatagaacagtgtgtgtaggggcttggggcagggggttctggagggtcagatgaggcggagcccaggggaggatgggggtgttattaatgccccaactcctgccagagccccagtccagccactgagtgcctcagaaaggccattcccagagggctgcggccctcccttctcctttgcccctgcccccagagctacctgactggcagggcggcactactgcaggagaggagcttggcctccgggggtcaggcaggaggggggcctggctagcctgtgctggctccactgggcggggagccctggaccgccaggtatgaggagggggtgggcttagggtcctgttccaggtccgtcccccacctagcaaggccccaggcaggacttggaaaccaggtgtgcacctgcaggctgaggggctccatgagcaggtgctgcctcgcacagggagttcaggcgccagccaagcccctgtgcttctggggtaggcctgcttcacttagggagcgctgcctcaaggcagataaagcccccttgttgacccgacctgcatgggggcctctcaggagagaaactctcgtgcgcccctttcccagggcgccctctttctagacagcattccagcccccaaacacaggtggcttttgggcccagatgggtcagcctgctgctcctggcccataccctctcaggccgttgggactcctgcccttcagatgtcctagggtctaggagtgggccagtcaccctgggaagaggccaggggcttggcaggaggggcggcccaggcgggacccagtcctgagtcctggagcagggccagggaggcgcccgccccaccccagccagccgccttctctgctgtttcttctatttgttcttcttttcacccacagccttgtgttcctgtcaaccctcctttcagcaaaagtcctgttcccgttccctctgtccccacccactcctgttccccaagaaaataagctatcattgttgcatttgcaatctatggattagaggtttaagtatttattattattggttaattattattatgttttatatatatatattagaacttggctagccaattttattgaacaattcctgttcaataaatgttgtttaaagtacagttgagaaaacgatggtaggtttatttcttgaactttcagaaattcaagcttaaagcatcacacgtttttctaatatcatgtggcgctttctgtcattttacttttttaacctttatatggaatagcaaccatcaaccttctctttcagatgtgccgtttgggggtgctaaagctggtgttaagatctatcccaagaactataccataagtatgaaagtttttgtttttgtttttgtttttgtttttgcttttttgacacagagtcttgctctgtcgcccaggctggagtgcaacggtgcgatctcggctcactgcaacctccgcctcctgggttcaggcgattctccttgatccagtaactgggattacaggtgcatgccaccatgcctgactaatttttgtatttttagtagagagggggtttcaccatgttggccaggctggtcttgaactactgaccgcaggtgatctgcccaccttggcctcccagagtgctgggattacaggcatgagccaccgcacccggcctcaaagtgatatttgtgcacacagtgcatttatgaaggacttgaaattactgggcttctctgtatcccccatatcagtgaaatcaatagtccccattgcttttcaaatggaatgaaaaaagtaaagaattaactcattgagtgttttgccatataaaggtcacctacttaatatctatatcctttatcattttctgttttgtttggttttgtttttatgagtcttgttttttttttttttttttgctttttgtattattattttcttatttaaaaggtaattaatatcttcatattattagacacctatacccatatttaagaagtactgtgatctggctgggtgcggtggctcacgcctgtaatcccagcactttgggaggccaaggcaggcggatcacgaggtcaggagatcgagaccatcctggttaacacagtgaaaccccgtctctactaaaaatacgaaaaattagtccggcgtgttggtgggtgcctgtagtcccagctactcaggagactgaggcaggagaatggagtaaacccgggaggtggagtttgcagtgagccgagatcatgccactgcactccagcctgggtgacagagcgagactttgtctcaaaaaaaaaaaaaaaaagaatcactgtgatctaattagccaggcatagtgacgcacacctgtaatcccagctactcgggaggctcaggcatgagaactgcttgaacccaggaggcagaggttgcagtgagacgagatttcaccactgtattccagcctgggcaacagagcaagactctgtctcaaaaagaaagaagaaaagtagtactgtgatctgaagtttttaggtcaggatctcatgctagtgacaaatatcttaactaagccaataaaaaccttactttttatcctgtcagttccaagtaaattcaaactggttgtcacaatgctttacataatactaaattatctatatacaaacataaacagatatgatttttattctctttaaaattcaccatttagatggaatataattatattacaattaatcttaattaagatttggtatatttttcagtggggaattaatagaatgggaatttgagtcctggttctactatcttgtttttataacctacttttttgatcccttattttctcacctttaaaatggcattgcctaccttatgagttgttctaaggatgagaagacatgaaaatgtactataaatagaaaataagatgctagctataatctcaagcgatttttgtatctttttttatttttattgttttcttattttacaggataacgaactggaaaagatcacaaggaggttcaccatggagctagcaaagaagggctttattggtatgtgtagccacatagattttggcataaagtgggaacatctaaaaaaatctttttttttttttttttgagacagagtcttactctgtctcccagactggagtgcagtggtgcaatctcctccacctcccgggttcaagcaattctcttgtctcagcctcccaagtagctgagactacaggcatgtgccaccacacccagctaattttcgtatttttagtagagatggggtttcgccatgttggtcaggctggtcttgaactcctgacctcgggtgatccacccatctcagactcccaaagagctgggattacaggcatgaaccactatgcccggcctcctactatttgtgataggagcttttgccaaacatacaacatttttgaagacactgatcttcgtttgcttgatgtcttcgtatcttactattatctgtgtttatatgttctttgtgtgtgatctgaacattctttcctatgatatgtaaatatttgtcatttaccttctaattttcaggcagtttaaacctctctatacatatatttttaatctagaaggcttctaatttgtttgaatagaatatacataattatttaataaaatgcttgccctatcagtatagttaatagaatgttaatagttacttaataatataatacttgccctatcagtatcagtatagttaaacaaaataaggtctacttaaataggaaataaagtgtatttttctctactttctttctcagcatttcccccaccatggacaaatgcctatgaaattaaactataaagtctgggcatggtggctggtgcttgtaatcccagcatttttggaggttttggaggctgaggtgggaggatcacttgagcccggaagttcaagaccaccctaggcaatatagcgagaccccgtctctacaaaaaatgaaaatgttatccaagcgtgatggtgcatggctgtggtcccaactactaagatgggaggatcccttaagcctgggaggttgaggctaccatgagctgtgatcatgccactgcactctggcctaagtgacaaaacaagaccacatctcaagaagaaagagaaaagaaataaagctattcagattcatttttaggaaaaaagtcatgaaataaatgtcatgaaataacctaatatagaaatacagtaagtataggtaactctaaaacttgactagatttggcctgtctttcataataaaaggcatttgggcctttgacgtgccgcatacccagcactactgtgaatttgtgcatcattacgaggagcctattaacatgagtgaactatctcactcacacttttataggagtacctaccgattctgagatatggtgaattgaagtcatgttcagcctgttaatagccttcataattttcaaaaggtctttcctcctcacctaaatctcaaacacattttatagtcttgaatggtttcagactttattcagtcatatttatcgcccatatctgcaatatctccagctaaattttatcagtcttgacaagtacctaataattccaaaggtcaaaaagtgattcattggaatactgaaagaaaacacagcttaaactctagtaacttgatttatttgcctaattcgcaaaggcctcattgacccatgatgcagctaaattgacgtcttggcccagacagctttgaagcctaggaggcaggcaaagggagttttttctctcacttctcggcaaaccttcaaattcgatgctatttatctgttatttcctgacactccacagagagtgtcagattgaggctcagacctgagcctgagccctgatcctatcacatgtgtgtttagcatcagcttgtaaatttctacaaaacaaaacaaaacaaaaaaaaagaggctgggattttgataggaattgcattgaatctgcacaccaatttgtggagtattgccatcttccccaccctccccaaaagggttttgccctttcacccaggctggagtaccaggcagcagtcactgcaaccttgacctcctgggctcaagcaatcctctcacctcaccctcccaagtagctagaaccataggcgtgcgcaactgcacctggctaactttttaattttttgtagagacatggtctcatcacgtatcccagactggtctcgaactcctggaatcaagcaatcttcccacctcagcttcccaaaattctgggattatgggcatgagccactgcacctgaccagtattgccatctcaaccatattaagccttccaatgctgaatatgagatgtctttccatttatttaggtctctgatttctttcaatgatgttttgtagttctcattgtagaagtcttacaactaagtattgtattccttttaatgctattctaagtgacactgatctatcgttttcttatgatgtctttgtctagtctttgtatccagacaattctagcctcatggaatgagttgaggagtgttccttcctcttctgtttttggaaaagcttttgaaaggtcggtgttcattcccttgtgtgagtgtaaatatcacctatgtaaagttctgcaggaccctgatgtctccacccttctcatccccttatatctctgtgcaccaaaattaccctttcatctcctactctatagtcacatgctgttagaaaagttgcttttttaaaaaagatgaacttctgcctcagaccgtgctctctatataagaatttacctgttaggccagtcgcggtagctcatgcctgtaatcctagcactttgggaggccgaggcaggcaaatcacctaaagtcaggagttcgagaccagcctggccaacatggtgaaaccccgtctccactaaaaatagaaaaaagtagccaggcgtggtggcgggcacctgtaatcccagctactcaggaggctaagggaggagaattgcttgaacctggaaggcagaggttgcagtgagctgacgtcatgccgttgtactccagcctgggcaacaagagtgaaactccgtctcaaaaatataaaaattaaaaaaaaaagaagaacgtatctgttattcaggagctacttgtaatctgtgcatcccaatacattagttttgtatggagcagaaaactagtaagcctaataattgataccttgtgattttgttttgggtgggtgaagctgtttcatgtttaacatgtatagactgtttttgagaaggattttatcattatatgtttgtgatttacaaactgtgtgcttcagacttgccacttgccagagcccttctccaattggaattgttttttgtttttgagacagtctcactctgtcgccaggctggtgcaccgtggcgtgatctcggctcactgcaacatctgcctctgaggttcaagcaattctcctgcctcagcctcccgaatagctggcactacaggcgcgtgccatcacgcccagctaatttttgtatttttagtctacaacggggtttcaccacgttggccaggatggtctcgatctcttgacctcgttatccacccaccttggcctcccaaagtgctgagattacaggcgtgagccaccgtgcccagccagcttttttgtttttaaaatatattgtttaatcaagatgggatctcactatgttgcccaggcttgtatcaaattcctgggctcgagccatcctcctgcctcagcctcccaaagtgctgggattacaggtgtaagccactgccccagcctagttggaattgttgtttgaggtaacaagcttacttaatcctaaagcaagcataatactttcgtagatgcctctagaaagattcgggaccaatttgtcatttgtacattgggagaaaaggagtggttaaacaaagttttactgacctccagcagaggtatgtcactaaaggaatggaaagtgagcaaacaggagctggagagcaccagagagcccttttgtcagtggatgaggctagaatatggcattaatccttccaagtgctgtgtggggttagacttctcatgaaggataggtttgggtaggttagacttcatgagattttttctgtttttaagttttttgttgtccttgttgacttcatgagatttttaaggtgactaagggaagggtgctaagacatagagttacagattaggtgggaggtggagagggttggggtataaaaagcagtccttgaacatttcaaagttgtcttataccagccctgtatccaatatatcacatcttgttcaaagaagttgattatctaggccttgggcccctgagttaaagaaaaacattacagtatactgattccgtcgactaaaaagtaaaatttataggaagaattgagtacagtccttagaaagaactttaattattttatggggggacataatggtttaatagtttaacctctttttttttttttttttttgagagacagagtctcgctttgtcacccagactggagtgcactggcgcaatctcagctcactgcaacctccgcctccagggttcaagtgattctcctgcctcagcctcccgagtagctgggattacaggcacttgctatcacgcctggttaatttttgtatttttagtagagacggggtttcaccatttggtcaggctggtctcgaactcctgaccttgtgatccactctcagcctcctaaagtgctgggattacaggtgtgagccacaacatccagcctaatagtttaaccatttttaaagttgtgtttttctttttgtaaagatgagtttctattatacagttgaaataatatagaaagttataaacaatatatatatggtgggtagaaagaatggggaagagaaagaaaattgtaagtgggaacatgttatacatgttgtatgaaacctgcctttttccatatgtatgtttgtgataattccaagtaatttacatgcatatgttatcctttttaatggctgtttagtactttgcataggtataccatagttcatttaattgacatacaagataattagattgtttttatttttactatgtttgagaggagtatttctgcacctttacggatttgagtgagcatcacttaacatgtttttatcagagatcttactgtagccgtcagtagtagtgcagtcagtgatttctgttattgcctgtaagctaatttgttagcctaacacttcaatttgctatgatctgaggaactgaaagctaaggcctaaaattttatatgtgctaagtgtcgaataataggtcaaagctgcattcttccacaagtaaagataatatggggcttaacacaattgctttagcaatgtgattttctcccctttttctctacttggtaaggagggcttatacccccactaagcaggcacatgcctgtaatcccagctactcaggaggctgaggcaggagaatcgcttgaacctgagaggcagaggttgcattgagctgagattgtgccattgcactccagcctgggcaacaagagtgaaactcaaaaaaaaaaaaaaaaaaaaagaaagaaagcaagcaagaaagaaagaaggaaggaaggaaagaaagagagagaaagaaagaaaagtaaatctgtggatattgtacaaaagattgttttatgattttttaattttttaacataacttttattgacttgtatttgtatttttatcaaacatacttcatttgtttatttatttattttgagatgaaatctcactctgtcacccaggctggagtgcagtggtgggatcttggctcactgcaacccccgccttccaggttcaagcaattctcctgcctcagcctcccacgtaactgggattacaggcatgagctaccatgcccaactaatttttttattattagtagagatggagtttcaccatgttggccaggctggtctcaaactcctgacctcaggtgctccacctgcctcagcctcccaaagtgttagtattataggcatgagccaccgcacccagcctcaaacatactttagacaatttttcacctcagcactattgacattttaggctatgtaattctttgttatgggggctctctctgccttgtaggatgtttagtaatatccctggcctctacatattagatgtcaggaagacccctcagttataacaatgacaaatatattcagattgccaaatgtcccctgtggagcaaattcatcccttgttgtgaactgtgatccagagagccaaatagtgatacaaggtttattgttcacaatagctcgtcccctccaatccagacatctgcctcaccatattccactccccagaggcaaccactttcaacaatcttaaatgtttcatttttattctatttaaagcctttgctcatttttaaattgggttttgtccacattattgagtggtaagagttctttatatactccacagccagttgtggtagtataggcctatggtcccagctactcagaaggctgaggcaggaggataacttgagcccagaaggtcaacactagtctaggcaacatagcatgaccctgtctctaaatgagtctttgaagtatatatattctaggtaattgacctttatcatgtatataatttgtaaatatttcctctcaatctattagttgtcattgcgctttcttgatagtctcctttttaatcttgagaaagcataatttatttttcctctggttggtgtgctttaggttgtatgtaagaaaccattgcctaatccatagtcatgcagatacatccctatctttttttttttttttttttgagatggtctcgctctgtcgtccagattggagtgcagtggtgtgatctcatggctcattgataactgcagcctctacctcctaggctcaagcaatcctcccccttcagcctcccaagtagctgggactatagcaccagctatagtcagcctcccaggtagctgggaatatggcaccaggactatagcacataccaccactaagcacagctaatttctgtattttttggagagacaaggtctcaccatgttgcccaggccagtcttgaactcccaggctcaaacaatcctcccacctcagcctcccaaagtgcaggattacaggtgtgagccactgtgcctggcctagagagatttttttaagaaatagtgaccaaaaatatcccacatttgatgggaattgtgaatctacacattgaagatgctcaacaaattcaaagcaggataaactcaaagagatccacactgacacacattataatcaaattgtagaaagctaaagacagaaaagcagcaagagataagtgattcatcctgtacaagggatcttcagtaagactaacagttgcttatcagaaatcacggagtatagaaggcagtggtggtgtgctgggcatggtggcatgtacctgtagtcccagctgactgaggctgagacaggagaattgcttgagcctgggaggtggaagttgcagtgagctgagatggcgccattgcactccagcctgggcgacagagcaagactccatctcaaaaaaaaaaaaaaaaaaacagggttggggaagctcagcatggtggctcatgcctgtaacttcagcacttttggagactgaagtgggatcacctgaggccaggagtccacaaccagcctgggcgacataaggagaccccatctctacaaaataaaaataattagccagacaaggtggctctggcctgtggtcctagctactcaggaggctgagacaggaggattgcttgcagccagcagtttaagactagcctggacaacatagtgagaccccgtctctacaaaatataaattaaaaaaattagctgggcatggtggtgtgcatctgtagttccaactactcatgaggctgagacaggaggatcgtttgagaccagaagttggaggttacggtgaggtatgatcataccactgcactccagcctggttgacagagcaagaacctgtcactaaaaaaataataaatgaataaaaatataagaatgcttggcctggtctgggcgtggtggctcacgcctgtaatcccagcactttgggaggccgaggcgggtggatcacctgaggtcgggagtttgagaccagcctggccaacatggagaaaccctgtctctactaaaaaaatacaaaattagccaggcatggtggcacatgcctgtaatcccagctactcgggaggctgaggcaggagaattgcttgaacctgggaggcagaggttgcagtaagccgaggtcacacccgattgcactccagcctgggcaaaaagagggaaactccacctcaaaaaaaaaaaaaaagaaaaagaatgcttggctgggcacagtggctcatgcctgtaatccctgcactttgggagtccgaggcaggtggatcacctgaggtcaggagttcgagaccagcctggccaatatggtgaaaccccatctctactaaaaatacaaaaatttgctgtgtgtgatggcacgtgcctgtaatcccagctacttgggaggctcaggcaggagaatcacttgaacccagaaggcagagtttgcagtgagcagagattgcgccactgcactgcagcctgggcaacagagcaagactcgggctaaaaaaaaaagctgaagtgagtccttcaggctaaaatgaaaagatacaagataataactcagagctatatgaaaaaataaaaatcactggtaaaggcaactatatagctaaatataaaagctagtattattgtattttgggtatgttattcctctttctcctttatgatttaaaaacatgcatgaaataatatgcatctatgttaataggaactaattgtttaaagacataatttgtaacaatatagctaggggacagagaaaggagcagagttaatgtatgctattgaagctgagttggtatcagtctgaactagacttagaactcagcatgttaactgaaatcttcatagtatccactaaaaacaaaactttaaaaatatacagaaaaggaactaagaaaggatcaaaatattacaggataaatcattaaccaaacacaaaagaaggtactgaggagcaaaacactttatgtagaaactaaacagcaggatgacataagtaagttctttggtgtgtgggtttttctgtttttcttttttggggtttctttgagacagagtcttgctctgtaactcaggctggagtgcagtgtttcattctcagctcactgcagcctttgcctcccaggttcaagtgattctcagcctcctgagtagctgggattgcaggcgcccaccaccagacccagctaattttttgtatttttagtagagatgaggtttcactacattggccaggctagtctcgagctcctggcctctagtgatccacccgcctcggcctcccaaagtgctgggtacagccatgagccactgcatccagcctgtttttggttttttttgagacagggtctggctctgttgcccaggctggagtgcagtggcacaatcacggctcactacaaccttgacctccgcaggctcagctgatcctcccacctcagcctcctgagtagctggaactacaggtgtgcaccaccatgcccagcttatttttctattttttgtagagacaggagtcttgctatgtcgcccagcctggtctcaaactcctgggctcaagcaatctgcccacctcagcatcccaaagtgataggattacaggcgtgagtccaaccataagtaagtttctgttttttgtttttgagtcaatctcactctgtcccccaggctgaagagcagtggtgcgatcatggctcactgcagcctcacctccaggcgggagccaccgtgcccggtcaagtaacttttctgtttcagtaatcactttcaatgtaaataatctcatcaatggaaagatcggcagaatcaatttttttaataatgtaatacataatccaaatatgcaactcacaaaatactcactgtagacccaaagacacaaatttgttgaaactgaaaagatggaaagagataatccatgcaaatagtaaccaaaagagagccagggtggctatactaataataccacacaaaatagattttaagccaaaaactgttacagaaaaacattttatgttcgtaagagagtcaaatcacaagaagatgtaacaattataaacacatatgaaccaaaaaaaaaaagggctccaaaatgcacaaagcaaactaataaaattgaaggaagaaacaattttacaatgatggagacctcaatgcagtggctctatcacagctcaccgcaatctctgcctcccagactcaagcaattctccagcctcagcctccccagtagctggaactataggcacacagcaccacacccagccaatttgtgtatttttttgtggagacggggtctcaccatattgcccaggctggtctcaaatgcccaagctcaagcaattcacccacctcagcctcccaaagtgctgggattacaggcctgacctactgcgcccagtcaacaccccaccttcaacagtaaatagaacatctagacaaaatcaataaggaactagaggaattgaacaacacactaaaccaactagacctaacagacatatagaaagctctccatctaacaagtgcagaatatatattcctctcaagtgcatatggaacattccccatgataaatcatatgttaggtcacaaaacaattctcaatacattttaaaaggtcaaaattatatgaagggccacatgtgttggctcacagctgtaatcccagcacttagtgaggctgagacaggcggatcacttgaccccagaagttcaagaccaggctgggcaacatggtaaaaccctgtctctacgaaaaaaaaattttaaaattagctgggtgtagtggtggtgaatacctgtagccccagctactcaggaggctgaggcaggaggatggcttcagcttgggaggcagaggctgcagtgacccgagatcataccactacactccagcctgcaggacagagcaggacctgtctcaaaaaaaaaaacaaaaaaaaaaaaacaaaaacaaaacaaacaaaaaaaaacaggccaggcttggtggctcatgcctgtaatcccagcattttaggaggccgacgcaggtggatgacctgtggtcaggagctcaagaccagcctgaccaacatggcaaaaccccatctctactaaaaatacaaaaaattagctggaaggggaggcaggcacctgtaaccccagctacttgggaggctgagccaggataatctcttgaatctgggagacagaggtttcagtgaggcgagatcacgccactgcactcaaccttgagcaacagagtgaggctctgtctcaaaacaaacaaacaaaaaaattatacaaaaaaaaaaagtgaactgcatgttgctgcacagtctaccatagcacaaatgtcaattgcttcttggctttcctggggtgatgggaggtctgaacctaacacagtctcacctgatccttcacaggagtcacgtagcctttctctctccagtccacagatgtggggatctcaagaagcaggcgttcctggaactgtttccccttcctgtgcttctggtattgaaaaccattcatcacctgcctgaattcttcagtggtcttcaaagaaaagtaaataaaatgttaagaagcaagagattaatttggtaaagaactgaggaggggaagcacagagctgggcagcccacagcatacttaccatgtctccaaaggcgttcatggccattgtgaagctgtgtttcccttggctgtattcctgattgtgctgctcagtcatcttcatgttctctcacactgctctcctccatccttcttcattctaaaggcaaacatgtaactgatgttcttcatttctttttttttttgagacggagtctcgctctgtcacccaggctggagtgcagtggcacgatctcagctcactgcaagctctgcctcctgggttcatgccattctcctgccccagtctcccgagtagctggaactacaggcgcctgccaccatgctaactttttgtatttttttttagtagagacggggtttcaccgtgttagccaggatggtctcaatctcctgactttgtgatccgcctgcctcggcctcccaaagtgctggtattacaggcgtgagccaccgtgccctgccgatgctatttatttctaattaaaacccaacatgtgctaaccaagtgaatcttcagacagagatgtaagagtaaccatggccagggaaggcttgacacttctaggagatgttttccaagctgagacacaacaagggtgtatgcccatatcgtgctcataatcagtgctattaagttattgcgttagcttattggtaggagccagcctctagaagccactctctggccatatgatcccaatagcaatgcccatctctctggggttcccctggacagtttcagatgccaccaaccatgtcatataatctcttgtgctttgccttccacttggtccattgtgcgtctaaactgtggtcacgtgttagagcagctgaggcaattcccaggcaaaaggcagccaggaggagtgaaggattcatgtttcaaaaatctaggaagggaaaagaaatgaggatctgattagaccgatcctaaaaagccattttactaccccctgagaaactagggccaccatggtagaataaaaatatttaaattattcttccaagcatttacctaaggactgtggaagaggccaaggatgtggctggagaaaaacagggcaagtggaggtattggagggacccaccaaaatgaaaagcagcctgtccagagctgtaggagttgaaacagttttctgggatgatgatgacaggctatgaaaaggacaggaaggtacctgatgggcgagaagcttaaggcaacaaccgggaaactaggaaaccgttggcccaggttttgtaccaattgtgctgaggtcatccaggcaaaacctcaagaatgaagacatctaatttcaagaagggacaaagggatccccaataattgggaagtcacatcacaccttgttcttggctaatacacaacagaaggtgaagtatgttttccaaatgccccttgtaatgaaacagttattgaatgtcttcccaggacaaactgggaaggagagcacccatctaccgccgttcccgcagtcctgcagtcctgcaggtgggccagtcctgccaacactccagctcccctcacagagcataaactgaatcaggtggccgaaccaccggaagccagagtccccagtgtccgcgcccacacaggggtgggtaggcagcttcccaggctttgggctggggacccaggccaggtctcctggctcttgctcccgccctccgctcatgctcactgtggccccaggacgtgggcgatgttgcagggagcaaggggcgcctctgcctgatttgccggggtcgagcctccctgtcccacccccaccggccctgggaatactgcggcctggcactccggaaaatccctcactcacagagctgaaggacttgctgggtccctggtggcccctgtccaatcttagcccactggggtctcagctgctgtagccacaggtggacaggcacagtgggcaggtgctgggtccaggagtctcctgtcgcctaaggccgcccgaaagcagctaattgacctctaaagcccctagacgcccctgcccccttgccgcccaggcaggcccgcccccaccacttgcccgctctgcgattggctgcgccagccgctgggcggggccttccggcgtgctgactcctggcatgtggagcagctcagtccccttgcctcagtggaaccgggggaggggagctgggggctacgaagagaagggtcggaggtctccctggagggttcggatcaactaagtaccctatttaatgccctgggcgggtggtttatgaaaagaaatttacaggagccctgtgtgcattttcagtttaaccctgcttttcccttaggcctagaatttttgattaaaatctcctgcagggcagagagccagaggactctaatccagtggttcctgtttagtccacagcaaaggtgcggctggctggaagaacgcacagcctgcaagcagaagccttacctcccaattaagggtgtagaagaatctgggcgtgttgctggtggctcatgcctgtaatcccagcactttgggaggctgaggcaggcagatcccttgagcccagtagttcgagaacagcgtgggcaccctggcgaaaccccttctctactaaaaatacaaaaattagccgagtgtggtggcccgcgcctgtggtcccagctagtcgggaggctgaggcaccagcatcgcccagcccggaaggttgaggctatagtgagccgagatcgcaccactgcactccagcctgggcgaaaggagaccctgtctcaaagacaaaaaaacaactggtaggaaaacgcaccctcaaaacacatgatgagatggtcgagaccagaccctaggagggtgggtactggctgggtgggtatccagagaccatgggcgtttcataatgcattgtttcccatctcctccactcagcgactcttcttcccctgaagtcttgcattaagtaagtgaatgaatcaatcatcaagttaatgaagctctgactttgtacttgttgtcctttgcttggtacagttgggcactgccttagaaacaatctccaggtaattttcccaactgcttttgtgaggcccagttttccattttaaaatctaagattacctcagtaatcttgcttttacagcaaatgggcatggagcctgacagatatatttaaactaagttatggacaagctgcctggtgcattaggtagcataggagctaaccttgtgggacatctccccatattcgtaatattcacccctacatctataatcaataaatgcttgtttggaggccatagaaactcttcctgagatctgacctgtgtcttctgctatctgcctgatttctccccatagaacaggaaaacactgtgtaggagatattgtgaatagaaatatgaatataggccgggagtggtggctcacacctgtaatcccagcactttgggaggccaaggcgggtggatcacctgaggtcaggagtttgagaccagcctggccaacatggcgaaaccccgtctctactaaaaatacaaaaattagccacgcatggtggcaggcacctgtaatgctagctactcaggaggctgaggtaggagaattgcttgaacccagggaggcagaagttgcagtgagtgagatggcaccactgcactccagcctgggcaacagagtgagactctgtctcaaaaaaaaaaaaaaaataaattacaaaaattagccaggcatggtggtgggcgcctgtaatcccagctactcaggagcctgaggcagggacaacggctcaaacctgggaggcagaggttgcagtgaaccgagattgcaccactgcactccagcctgagagacatagcgagactccatctcaaaaaaaaaaaaaaaaagaatataaataggaaatacagtgattcaaataagcaattgttagttcctcagatcagaactgtgagttctatactagactcttacatgttatttcttctggtatcttagcaatgattctgaataaagatcagactccttagtcggcaggtgggacagttctcaataacagaagctgggttctcaggggatcccgtggatatgaggatgaaggttagaagcacttgggaccatacctgcaggtctgatttgaggacaatgagaccaagacaggaaggcagcacctgctgaggggctgggggtgggagaagggaggaaacgggacacaagaaaataagtataaaccaccagactgcagtcagtgatcaacaaaattcccaagtttatattgagaagatttccctggtttggggttttgaagagattatataagggattcgggttgcttgatttttttcattctttttcttttaacttggtctcaatttttttgtaaaaaaaaaaaaaaagaatgtcttatgtgcgcctttagaactggtgaatgaatgaacctccctttttaaataactgagattgtcactgaagcactgtcatccgatttaggcttaaaaatctgacactgaatttatcctagatgataaagtgcaagtctcttgtctcctagaaatgatcaggcaaggaaacacccaggaggcccagggcaaaatgccctcctggaagctggtggggtaggaagatgctgaggcccagtatggtccctggagcatgcattctgtgtggtgacagaaattgtttgcttgaccgtacattggtcaggcttctgaaccttctgctaaacccatctgtgcactttttgtaaaattcagttttaggaaattaccctgctaagtcagtttagctggcaggaatccccgtccaccatatactgatcagggtcctcatcccccaccatcccgcagctgatgtcagataaccttggcctgtgctcagcgagaatctcgttaggtcagtttagccagaatcctcccttacccttcatgttccctcatagtcatttcctatctgctaacccccatcctcctccttgagtataattaccacttccttgtgctggattcagagttgagcacaattgctctctctcactgtaagaactacttgcagtgctcctagacctacatatgtgaacctgtttctttaacagtgactcacctgtctttttctcctttcaacttgacactagctgaggcttatccgcatcaaagtggagggactggccccgggggatcctcagggcttcaccttgatggcctgcaggctcacattccactttttctggtgccttctggctccgagtccagtttgccacacaagtgatggaggttggaaggagggatgaggtgacagaggtgaaggagggtaaattcttttctaagccctacttgcctgacatgcatttaggtttttagaaaggaacctgaccccaccctttattttctatctcccacttccatgactagccttacctgtaaaaatggggcatagaagagcccccatctcctagggcagtgtttttgagcagggggtcactgaacagtagcaccttcatctcttgggaccttgttaggaaattctggacttggggtggttgatcatgcctgtaattccagcactttgggaggccgaggctggcagaacacgaggtcaagagatcaagaccatcctggtcaacatggtgaaatcccgtctctactaaaaatacaaaaattagctgggcacggtggtgtgtgcctgtagtcccagctaatggggggctgaggcaggggaatcacttgaacctgggaggcagaggttgcagtgaaccaagatcatgccattgcactccaacctgggtgacagaggaagactctgtctcaaaaaaaaaaaataaataaaaattcctggaaatggattagcttgctgacaagagttattccattgtgtgtttctacctgcaatacctgaggatgcccattttctcacgatttataaactaactcattttatagatgtaattttcatacatttgggggtatcgttctaacttcattattattacttcaaggtgttattatttccccatcatcatcatggtcattatcataactagttggtgctgacagtagtcaccctgcattgagaactcatgctccaggccctttccacatagacttgatttaattccattcactcctcacaacaatcgtctgaaagaaagaatcactaagccattgtataattgaaacacaagaggcgagtgacttgtgtgcccttgggcaggtaatttaaacactctgtgcccccaagttccaatagataaatgtaaataataatatctttcttacctaatacatggggtcaacagttaaagtactgtacatttgtgaggtatttcatggcacctgtgaattgctcatgtgatgacttagtgtgcttccagtgtcagtgtgctgggaaggagacagaataagaagaagactgaaaagatgccgagtctagtgcagggtatcctggggaaaacacctcctgtttgtccaacagcgattggccacacattgaagacacactacctggctgtgaactggggtgaccctgttgaaatcttgtggaaagcttgagatgctccttagagggtgtttatccctcgagctggcacaaatgcggtttgttgttcagtttttccttctactctgcctctatctggtacaaaatggaattgaagaggatataaaccagcaaggaacaatctgaaatcagaatggtgacaatgggagaaagtaatcttggttcaacccaatgttcacctgaagtctctttattaaagactactaacaggaacgaaattgcataataatcttcctatgataatttcaagttccagaatttctctatggaactttcaaatttcacctctgttaactcatggaattttccctagaatctgcaaattaccgaagtctttggaggtttgatgatcactcactggtcagcggtactacaaaaggattctggggagtttgactcagtggtcagcaaaggctcttccgaatcttcagtctgattctgagattccccggggagaactggagcctttcttaacagctgttgattggaaagaccacctgcttcatcctctattgcaacagaaatagccattgtgaatctccatggggaggcacaatgagttttttctagcatgtgtgactcaggtcattttgttccgtggtttccagttgtggggacttggcaaggtcacaccctcccctgagcctcagtttcatcgctcagaaaatgaggataacaattctacttgcctcataggattgttgtgaagattaaatgagacatgtaaacatttgcttatagtaatttcacaccactttattgtggaatcaaagacagaattcttacagaggtcttggttagttaagaaaacatccattcaaagatttgattcacaggacaccctcactgtctttctctcttttttttttttttttttttttttttttgagacagggtctcacttcattgcccaggctggaatgcagtggtgtgatctcagctcactgcaacctctgcctcccaggctcaagagattctcccacctcagcctccgagtagctgggattacagccatgcactgccactcctgggtaatttttgtatattttgtagagacggggttttgtcatggtgcccaggttggtcttgaactcctgggttcaagcaatccacccgcctcagccacccaaagtactgggattacaggcgtgagtcaccacacctggcccttgcttactttcgtacttcccaagaggcaggttaccaaattggtgaaattaaccataacatcattgtgatgggcaagcagatatattaaaagcaaagatacagcaggttaacattaaattttgctcatcccaggacaaacctggccacaggaggcctttgccagtattctgaaaagtgttgtgaccatctcctttaaagctcagttaaaggtttctggctggactccaggctgcttcaagctctttacttgtctttatcattctttaaggagggacccagacacagtatgcagaggcctgaatcctctagatcattctctctccaccatgagtcctgccgtggggacttttccagctccctttggccttatgagccagaaaatcaggctagagcctaaagagaacagaaatttcagaatcaggcttgttctgcgactgtatgggggagctgaaggacacaatgggctttctatattggagactacccatcatactctctctgcccagggagaaaggacagatgctgtgtgattttgcagtctgtgatttggcttctcattctcgctgctctctacacctcattgtttacttcactcccctgaaaaaaatgctccctaacaggctcagtacccaacttctgggtattgctgcccacatttgccttggttctaccttttcagattgcaggatcctgaggttttgcttggagcagctcagattctccactagatctaagatctcacctagtcctgaggatttccttaaagggaaggggaaagatagatagatagatagatagatagatagatagatagatagatagatagatagatagatagttgctgcctttgctctacagcatctgcttggtgaagaggctcaggatctggatcctggcctctcagctctcaggaaccccattcccccctgacaggggtggcaagttcatcctattattcattaagaaatttgaaaacaatcattcaggaattttaggtcaagagctggaaaaccccaagcctccatcacctgagcaaagggagatactgtgagcacctgcaggatacacccatgttccaccacctgcctgaagaagcctgtggttcttgtcagcttctcaagggtgaagtgcagatccttttctgcttgagcagaagagcagaccaaagagctcattgactcaaggagcatcacggcaactgagctgcacctggaagagaagaatccagggtgtgatccacagccaaggcctgaagcaatggggcccatacttggcctctccagggtgagttgtgacccaagtgctgggctttagcccatgagtggtccctcttgccatttccagtttcctcccaaagagaggccagtgttggtgatttcatttcttataatctccttaggagcacaggttttggtttgtgccttttttggatcaggttccctgcattgcagctgctataattaaaactattaacaacaacacagcaccacagaagcaagttagttgctaatggaatttgctgataatgctgtcttctagagaccactctagtaactggagagccttggtgtagagctgatgataaaacctattcctgcttttgtcagtcatgaggagcatttcctttctagacagaggaactgaaacccacatgccagcccaaatttaccaaaagcagtcactggaatactcatcacaccatcatgtctcatcttatccctttcgttaccttcaaatacggccccgtttcctcaggaccagaactcccttatgtgggcagcaggactaaggcccttgagttacctgtggtgactcctcattaaatggaggaatgtgccagtattttcagcaaaacatgaatctgatgaaacactgactgaactgtctcctagtttcaaaacaaattattaccactcagggcctctatttagggcaatcagagtcagaagtgggaacgcatcttgtcctcctaccttgattaacagtaactctaattgcaggatgatggtcaaatcctctctcctctaatgtgcagttgtgaaggatttaggctccactgctcatgcatttgggtggggcctgaatcactttcagtctagcacaggcgggtcacttcaggccttcccacctccatcagcatccttcaatcctcccctgacatctctcatttatgcttcctattgattcagaggtcccaacccgagtggctaaaagaaacattcattaacctttctacaaagtcatgaataatccatggattacattgaattcatccctactaaaaccatcttcagaaattcagatgtagtaaccttctttctgaatttttttttttttttttttttgagatggagtcttgctctgtcgcccaggctggagtgcagtggcatgatctcagctcactgcaagctccacctcccgggttcacgacattctcctgcctcagcctcccaagtagctgggactacaggcacccgccaccatgcccggctaattttttgtattttgtttagtagagacggggtttcactgtgttagccaggatgatctcgatctcctgacctcatgatccgcccacctcggcctcccaaagtgctgggattacaggcataagctaccgtgcccagccaagtattctatccttaatgaacacatatatgcacattatatctattttttataatatatatatttagaattgaatgtcagagtacatatcagtgttggaggaagagaataaggaggaagcacagaaagtaaaaaggaaaaataggcaccaaaaaagatttggagaatggcagatggccaaggagatgcagttgggaagtgcctcttccatggagaggaacccaaatatctagtaaaccttcacattttaaacagatcttttgagagaaaacactgaaagttgacacagaggtgacacagacaccatggttgaagagggaagaaatgggacagtctgctcagagtcactagacatcaggactggcccatataccctgaacaaacccaaggaaggggtgagtgaaggaaccctgggacactacatacccataatgtacctctgagatcctagttacaggagtttctacgaccctcatagatctttggactggtaggagagctgcctcgagcacatgcagaggcacagtttgaacccacacagagcccagaaggctttgttgtgctgtgcagctgcagcaaaatgcaaccctaggtgcccatccctcaagcctccatttcatactgagtggctaagttcctgctgtccgccaggctgggagtgaaccacgcctggcctgctcacatgcccaagataggccccatcaccagtgctgtgtgattaagttgcatctggtccacatgcccccttgcctgtcaaccccttcccagagctcatgcctggtcacgcctgcaagagggtgtccacagcacagcatccactgcatagcttgagtgttttgttgacagcctgggaaaagctcaccaccctgtccccaagtcacagccagtgcttgaagcttagaggccagaggacaaatccgtgagcccagtcccaactccccaagactcaagtataccacccagggacactgagctgagatttgtaacctaatctcaagtgaaggaggatcctccatagtcagaatgcagagaagggtgtggtatgggttctcatgggggcatgggaactggacacccctccctttgcaagaccagaccatgaagggtatggcctgatggtggtagcttctttcccagggagtgtcctggcacagaatgcctggagcagctcaacaatgtgggagcagatggcttggggaaagcctagttggttgggcttgccgccagggcgagtgtctgtgggagatctgctgggtcaggggagtgtaagctaggcagactccatggttgcctgctgggctgaaaatcatgggctgcagactccatactggtgttgcacccattgtgccactgccctgcctggagatcctctacccttgaaatactgcatcatcagagcaactgcagacataccctaaaacctgctctgactttggtaagcacagtggactggtgggtctctggagagttgtgtgtccctagagatgtaatcctcagtgtggaccatccctaagggaagggggagtgcagcctgccaaagcacaacatgagacaaagaaaatgcggccatggcataagccactgaaaggagcaccaccaaggcccagaaccagacttggagaaggaattatgtctcgcctccatctcccctccccagtgcactgttgcagatgcaacaatagctcttcccataggggcccagaaagcgtgcactgaaagaagttgtttctcatgattctccagtgagggcaagcatgcaccaagaccccacctgccagctcttactcttaagtccatctaccagactgaagtttgagttataccatcatataaaaatacattgctaaaacaagcaacatctgtgaaagccactgcagcaacctatctgtaaccaaggaacatatatggaaacttcaccctctgcaactacagagaaatgaagccaatcaatcacatacaccactgtcatactttcaaagagaataaaaaatataaaagccctgtgatggttaatactgagtgtcaacttgattgtattaaagggtgcaaaatattgttcccgggtgtgtttggagggtgttgccaaaggagattaacatttgagtctggactaggagaggcagaaccaccctcaatctgggtgggcaccatctaatcagctgccagcacggctaggacaaagcaggcaggagaaggcagaagagcagacttgctgagtctcctggctttcatctttatcctgtgctggatgcttccagttcttcagcttttggactcttggacttacaccagtggtttgccaggggctctcaggccttcagccacagactgaaggctgcactgtcagcttccctacttttgaggttttgggactcggactggcttccctgctcctcagcttgcagatggtttattgtgggactttaccttgtgatcgtgtgagtcaatgatccttaataaactccccttcaaatgtacatctatcctattacttcggtacctatagagaactctgactaatacaaaccccatctaaatgaagcaaattcaaaaaagaagtgtcaactcccgcagatggaaaggaataagcacaagaagtctggcaatacacaaagccagagtgttttgtgatctccaaagcctctcactagctccctaggaaaggatcctgaccagatgtaaatgtctgaaatgagacacatagaactcagaagatggatgtcaatgaaagtcaatgagacataagacaaaatagaaatccaatgcaaagaaaccagaaaaacagtccaagatttgaaagacaacatagttatattaagaaagagccaaactgaacttctggaactgaaaaattcactaaataaatttcaaaatatagttgggagacttaaaaacagactaggccaagcagaaggaaacacttcaaagcttgaagactgattcttcaaattaacccagtcatgcaaaaataaagaaaaaatattttttaaaaagacaaagccttcaagaaatatgggattatgtaaagaaaccacttctacaacttattggtattcctgagagaaaagaaagagtaaccaacttggaaaacatatctgaggaaaaaattcaagaaaatattctcaattttgctagagatgttgacatgcatacaccagaaatccagagaacctctgttatacactataaagacagccatccccaagacacatagtcgttagactatccaaggttaacacaaaagaaaaaacaaatctcagacacagctagagaaaagagcaacactacctacaaagggaacccatcagactaacagtggacttctcagaagaaaccttacaatccagcagagattagaggtctatttttagtactctaaaaggaatgacattccagcataaacattcatattcttcaaaactaagcttcataaacgaaggagaaattgagtctttctgagtcaagcaatcggtaagggaatttatcaccactagactagccctgcagaaatgcttaagggagttctaaatgtggacatgaaagaacaatacacagaaaaagcacagttaagtacatagtccacagactctataaagcaactacacaattgagactgcaaagaaactagctaacaaaactatgacaggaacacaatctcacatatcaatgttaaccttgaacataaatggcctaaatcctccgcttaaaagacatacagtggcgaattggaataaaaaaatcagaatcacccatctgctgtcttcaagagacccatctcacaactaatgacactcatgggttcaaagtaaagggatagagaaagattaatcatgcaaatggaaaacataaaagagcaggagtttctattctcatatcagagaaaacagatcttcagccaaaaacagaaacaaggacaaaattgttattgcttaatgacaaagggctcaattcaataagaataattaactatcttaaataaatatgcacccaatattaattggagcatcacgatacataaagaaatcactactagacctaagaggtagacagcccctcagtaataactgggaacttcaacactccactgacagtggtagatagattattgaggcagaaatctaaacaaataaattctggacttaaatttgccacttgaccaattgaacctaatagacatctacagaatactctacccaacaaccacaatatatatatttttttctcatcttcacatggaacatactctaagagtgatcacatatgcagttataaagcaagtgtcaagaaataaaaacaatcaaataatatcaagcatcttcttggaccgcagtagaataaaaataaaaatcaatagcaagaggaactctaaaacacagacactcacacacaaacacacacggaaactaaagaaattactcttgaatgacttttgtttgggtaaacaataaaattaaagcagaaatcaaagaattttttaaacaaatgaaaatagagacacaatgaacaaaaacctctgggatgcaataatagcagtttaaaaaggaaagattatagtgctaaatacctacatcaaaaagatagaaatatctcaaattaacaatctaacattgcacccagagcaagtagtaaaacaagaaaaaaaactacatccaaatatagcataagaaaagaaataacaaaaataagaacaggactgaataaaatcgagactcaaaaatccacacaaaggatcaacaaaatgaaaagttggttctttgaaagtgtaaccaaaattgatagactgcaagcaagattaacaaaaaagaaaagatccaaataagcacaatcagcaataacaaaggcgacattcaatcgagtcccacggagattcaaaagattctcagagactactatgaacatttctatgtgcacaactagataacctagaagaaatgaatacgttcctggaaacacacaacttcccaagattgaaccaggaagaacctgaaacactgaacagaccaacaatgaattacagaatgaattgaataagtaatagaagcctaggactagatgaattcatagctgaattctaccagacatacaaaggggagctcatgccaatcctactgaaactattccaaaaaatcgaggatgagagattctcctctaacttactctacaaaacctatatcatcctgataccaaaatatggcaaatactcacacaaaaaacaaaaccctaggccaatatatctgatgaacatagatgaaaaaatcctcaacaaagtacttgcaaaccacattcagcagcacatcaaaaagataatacaatatcaagtgaactttatacctgggatgtaagagttgttcaaatatatgcaaatcagttaatgtgattcaccacataaacagaatttaaaatgaaaaaaaacataagattatctcaacagatgcaggtaaaacatttgataaaatccaacatgccttcataattaaaaccctcaatagactaggcattcaaagaacatacctaaaataataagaaccatctattgacaaacctagtctacgttatactaaacaggcaaaagttggaagaattcccataagaataagaacaagacaagaatatccactttcaccactcttattcaacttaatactggaagccctagccagaatgatcagacaaaagcaagaaacaaaaggcatccaaataggaaaagaggaaattaaattttatttcttcactgatgataggattctatacctagaaaaccctaatgattctgaccaaagactcctagagttgattaaaaatttcagtaaagttttaagataagaaatcaatatacaaaaagcagtagtatttctatacaatgcaatattcaaactgagaaccaaatcaagaacacaatcccatttacaagagccacaggaaaaaaaaaaaaaaagaaatacttaggaatacctctatccaaggaggtaaaagatctctttaagtagaactacaaaacactgctgaatgaaatcatagatgacacaaacaaatggaaaaatattacatgcttatggattggaagaatcaacatcattaaaatgtctttactgcccaaagcaatctacaaattcaatgcagttcctatcaaactgccaaagttatttttacacagaattagaaaatcaattctaaaatttgtatttaactaaaaaagagcctgaatagccaaagcaatcttaagctaaaagaacaaaggcaggggcaacacattacctgacttcaaactatactacaaggctacaataaccaaaatagcatggtttgggtacaaaaacagacacatagaccaatggaacaaaatagagaatccagaaatgaagtcccatacctacaaccaactgatctttaacaaaattgataaaaatacaatggggcaaggataccctattcaattaatggtgctgggaaaactggctaaccatattcagaagaatgaaattagactcctgtctctcaccatataaaaaaattaactcaagattgattaaagacttaaatgtaaaactttagactataagaagcctagaattagacctaagaagctcttttggatattggcctatgcaaagaatttatgactaagtactaaaacacaaaagcaacaaaaacaaaagttgacaagtgagaccaaattaaactaaagagcttctgcacacttgcatgttatattgcaaatatgaaatagcaaagacatggaatcaacattggtttccaacaatggtggattggataaagaaactatgatgcatatacaccatggaatactatgtagccagaagaaagaatgaaatcctttcctttgcagtaacatagatgtgcctggatgccatcatcctaaatgaattaagatgtaaacagaaaaccaaatactgcatgtcctcacttataggtgagagctaaactttgggtacacaggagcaaaaggatggaaataacagacactggggactccaaaacaggggaaggaaggaaggcaaggtttgaaaagctacttattgggtactatgtttactattcagataatatgttcaatagaagcccaaacctcagcatcatgcaatatattcatgtaacaaatgtacacatgcatgcttaatctaaaataaatattaaataatcaaataaaatgatttccatgaataaaacggtagatatgattatgtggaaaatgctttactatttattatgtggtgaataatttaataatatttaataaatacatgaatgaaaaatagctacaactgtgtgttaggatttcaataattttttatttcattcctataacttttatgtattattatatacataataatatatagttaataataacaaaaacaacatggtattgaaataatttccacccagaaggaggatcaacatatttaagtgactacactactcgagataaaaatcatttatcaaacagatcaaagtcatttacctgctttcctttttataggtcctaggaacacacgtgccatagacaataaaacatcacttcccccatcccactaccttggactttatttaacatctttgggtagaacagaaactgttgataaggtgagttttgttttatagacaagagaggaaaatggatactttttgtggtctgggccttagaaacagactaagatcttttttttttcttttttgctttttttactagcataaaatattaattggcaaaacaccgaatacaagcttcactatcataaaatcaaaacatttaagcaatattccaaaaaagatttgacaaaaactagtcaccaagagtacaaaaattacacatcaacacaaagcataaaaaatgtgaactttcaaattaaacagtcaaaaacatgtacctgcgtgatcacctccacaccttgactgccttcgtctgcagcacgctgctggtaaaggctgggtggctgcaccgtcgtcccctaacccaacattgctttcatctgggaaaattcgcttgatagccaattaagccatggaggctattacatttacacggggctacgcacaatctcaggggacgctcaaacagcagttcgttcctcacacgcactgttgggtgcaaagggcacctggagagtgagggagacctgggcgctttcctgcggggccttggccacgcggccgtcgcccgcaccctgtcccttgcctggcaggggacacaatatttgtacagattatggtataatttgaatgattttctaatctacttatcttaatttatatagtttatttaaatgtcaaggcagagaaatacattgatcatgttaaggtcacgtgatgtggtggcgcagtaatgacttcctgaggaaacagaaatcggatgttttgtgatttagctatgtgcactaaacttattttccatgttttgagagcacattaaacattcacgtacaatgtgggaataggctggctcgtaaccaaaacgtccaacccaatgccaccctttgaatcgctgtgaacaccgtcctattgcggttcagagaaaacaagcaaggctgcgaagccccggggttcaggcagctgcagcgcttgggccaaggtagctccgctctctggtctgaagccacgtggccccaccccggggcggcctggcttttttatagtgcttattgctgtgtttggcatgccattcaacccatcgggatgttggatagtgacttgagagcaatccctagatttgccctgtcgggatgttgcatactgagttcggaataagccctgctcaactgaggcactatcactaggaggaggcactgattcccgcctttcaatgctatctattggtgaaagaggagttggatggcatctgggaaattagtatcacttctactttttcttcttttcttttaaaggttaaaaataccttgtattagttaatactgctataaaatatgaatatccaaatctctgtggctcagtaaaatagatttttttttcactcagagaaagttcaggttcacccttagtaacccaggctgacagagactcttccattttctatacatagcttccccaattgcccagagaagagtggaaagatttgataggtgactgtacacaagaataagaacttagtacctagtcactaatttactcgttgaataaacatttatggagcttaacatattaatcactgggcagacgctgggacacaagaaaaatctttaagatatgtcactgcttattaccaataatgttctagtgagtaacaagagttaataacacgactaattatagtattgtaaatataattacagttccaataagacatacacacacacagaacgattttgtctggttgttgaggaaatctttattgatttaagatatcttttgatgaacaggatttttcaataactatcagaaaaagaatgtctatgacttatttttaaaaactattttcttatctgccttgcatatctgacactttcatctcctatcttccttgaatacaatatagaacctgacatttctttcctttcaaagatccttagagcatttcctacatttaatctgaatgtctttctcagtaatttttcccatacaagcaattatggctacattttcttaatataatcatgaaaaggtgagcaaaactgaaaatttaatttggagaatagatacgaaacattcaattaattcaagttgttgttaggctgcatatgttcagctttcagtgaagatgaacaaatgatgataaatgagaaactgaaagaaaacaaaccaataggtgttttttaagaaacaatattattaaagtgcatgtgttttctactgaatgaaagcaacatagaccttttcctcacattggtagttagtaagatgtataaaaacaactttgtaaagaacaattaatacaggttaatgaatcattgtgaaaaggggataacacactttattgtagcaatgatctgcaaggtgttaaatgttaaaaaagatgaagaacaattgagtagttatttgatcacagtgtttattaaattgcttttcctgtatctggcaagctttacagaaatgtcttcaacagaataactgtgttaaaagccaaatgaaatgcattttgaaatatgattcttcacttggtgtgcaggtataatctcaggtgtaattcagacaagagacaaattcaattttaaagttccatttgttacaatttgatgattgtgattaaagaaccataaaaattttatctttgacatttcattttttcctcacaaaagtattctactgcaattttcttagttttctttcctcttaactgtggtgttacctataaatgctggatttctctgttttacgtgcaacaaatctacaatcaactatttctggaacgccacttcattttaacaacaaggacccataaatattttaaaaattcaaaatgttatatataaaatgttaaatgatacacataatacatttctaagtagtaattatgattatgcccataattatacccataatttaaaaatatgttacctgaagtaaattattatacgttttatgttggaagtgttcatttatctttgatctctgttaacacattgtactatgtggtaataatataaactgccttactggatagtgatgtatctttggtttcatattgttactggactaatattccaacactatagatagtgaaatttaacattgaaacaatttgataatgccatcaatgaatccagtttttaagagtgggatccattttctaaaattgagtatatagatacttcatgagatatcttatcatgcatcctaaaccaaaccaacctcttcccctgactgtcttacagtgtattattattattttatccaccacagcaactagtacatttttcagaacctagtagatattcagtcattgtctatggaatacatgaacacattctgaatttggacagtcatcattcttggtgttttaaaacaaacacttcctgaattgcatccactattttctaagaagccctaggaattcattgaaggagggtatgggtaagttgtgggtgaaactgtaaagatgtaggtcctcctcccaaaacttcttcagcgtatcttcattgctgtttgtttgcttgcttgcttgcttattttaaaagagatctagatatagtctaataagaattgtataaatgtgatgttccacaatgattctaacttacatggtgcaaaataataaaatattacattctacctgtttgtagaaaaccatggatactataaaggatctagattttctctctcctttccttctaagatttattcactcagcaaagacttacctggtgactacttagtgctagacactgttttagatacttgggctataacagtgaaaagaacagtaattgaattaatgaaaagttcattttaattagctgtatggtaaaataggaaactaacaaaaataaaatataacatgtcaaatggcaatgactgctctgagaaaaataaaggagaataagaggttctaaattattatatacggccaatattaccaacatattatagaaagaaatgagttcataatgtttatcagagaattccatgaaaatcgctaaatttttctagaaagccaggcactgataagagaataaacaaacagataactgattttaatttgatcttctcttacaggtgcagctatgatctgccattgtatataatataaaattaaaaattgtttatatttcattcacgttagcatataatgttcttacttttttttttttttgagacggagtcttgctctgtcacctaggttgaagcacagtggcacggtctcagctcactacaacctccacttcccgggttcaagtgattctcctgctccagcctcccaagtagctgggactacaggcaggcaccaccaagcctggctaatttttgtattttattagagacggggtttcaccaaattggccaggctggttttgaactcctgacctcagatgatctgcctgtgcctcggactccaatagtgctgggattacaggcgtgagccacagtgcccggccaacgtttttacatttaaatatcagacatctatcatattcctttctccctactacaaacattgtatgcttttcaataggcataagattttgttttcactcaggttggattcaacaggtattatttagcagttcattgcatctatccatttacccaatagaggaagtatacaagatacaaatgaataaagtgtaataattcttatactatttgcccttatgtcatgtaactgctccatgtttgtattccgaaaacctaactgggagggaaaactcagaaaaatagaataaaaagtattatatatctcatacatcctcatttttgaatattctaggggtacagatcagtataaataaaatactctggtaagtgaccaccacatcatctgtttgtcattcttagacccagagtataccattcttttaagaaagaaaacttgctactgtacctgctacccagtaacatatatatcacatatcatatatatatcataacatatatatcatatatcatatatacacatatcatatatctcatatatataacatatttgctactggttaggagtaacactcagaaaattatacttaataatgtagtacaattaggtataaattcacttagtatttttaaattttacgtatattcctatttatatgaatcgtcatttaaaatcacatctactgatcctgatagcattaaaggcataagaggtactgaggatattaatttaattttgtttacagctatgcacagatatttttagttcactgagatttaatccagtagtctattatttgattaattgtacagctatcaaatcattcaggactcccactgtttcaacaacgagagtggaaaaatattttttcatttatgtttatatgcagctatttgtagtctaaattaatatcctagcaattgatggtgaaattaaaattatttctgtcagatgtggtactttgatgacagtggataagcatgggaataaaagaaagttttgaggaagaggggacagtttttgtttacttaatgattattccaaagatgttaagtaaacattctatagaatgcaacatatagtggaatacagcattgaaacaatttaataatgtagtcaatgaatccagtttttagaaatgggatccattttctaaaactgagcatacagatacttcatgagatgctttatcactcatcctaaaccaaaccaactccttcccttgactgtcttgcagtgcatagggcatctctacactctaggaaaggaattatcaatctgtttatatgccacttataaaatcatacttaatgtacgattaggcataaatttacttgcatttttaaattttgtaaaatgttaacggaaagtgttcttgaaaaacatttctgagaattccaaaaaatgaacaaattttaatacataagggacaatatctttctagtgaattgattatcagagtgtaatgtggtatgttctgattatgttacataatattctgattagcagaaaattttgaataagtgaatttagcaaaatgtttagaggtcaagaaaactgttttagactgactatgttttctgacccaaatgtaagaaagaacccaataaaaagaggcagccagataatgctgttgtttgcaaacttaaacagaagcttgcatgtaatttatgactcaaagaaaaataaaaatagaagttatactttatttagaacttaatgacagtgaaaaattgcacataaaaaggaagactgttgaatacagcaaaagctggaattatataagaaatataaacataaacacacaaaataagtgtaaattataatgaagtaaaaatatatcaaagagaaagaaggaagcagtacaataaaaaataaagttgattctttaaaaaccatagttaaatagacaaatttccagccagattgtttaccaagtaaagagaaaaagaaggagatagatcaaaagacacaagatgatgatgaaaagagggtcagcacttataaacatagtagaaatttaagccataatgagcacaagaaagcattatcaacttacttttgaatatataaaatagacacttaaaaaactgaacaaaaatgacttactagttttaaaagaaaaaaaaaacatcaaacatctatccttccaaaagtatagacttcaaaagtatagtcccagaagggtgaacataaaccacactttaagcaagaactctcagttataaccagatgggtgaacataaaccacactttaagcaagaactctcagttataaccagatgggtgaacataaaccacactttaagcaagaactctcagttataaccagatgggtgaacataaaccacactttaagcaagaactctcagttataaccacatgggtgaacataaaccacactttaagcaagaactctcagttataaccagatgggtgaacataaaccacactttaagcaagaactctcagttataaccagatgggtgaacataaaccacactttaagcaagaactctcagttataactgcttgcagttttagaggatcccagccacactcctgaaccagagcttggcactgggtattccctctggaacacccttttatttccttctctaagcaaagacatggaatcaacctaaatgcccatcagtggtctgctggataaagaaaatgtggtatataaacaccatggaatactatgcagacataaaaaaagaacaagatcttgttctttgcagggatgtggatgtagttagagaccattatccttagcaaactaacacaggaacagaagatcaaacactgcatgttctcactcataggtgggagctaaatgatgagaacacacggacacatagagtgggggacaacacacactggggccttttggagggtggagaattggaggagggagaagatacaaaagaataactagtggttactaggcttaatactggggtgatgaaataatctgtacaacaaaccaccatgatacaagtttacctatgtaatgaacctgcacttgtacccctgaacttaaaagttaaaaatgaatgaagcctgtcagaaccacccatttagcagtctaacattttgcctagtattcccaaatccctttgcctagccaacatttttcacagcactttttgtcttcaaactactggcctgaagcaatctggcttagctttctgagtagctggaattgcaggtgtaccagtgtgcccagccacagttttttcaagacctgtttaagacaacaggttagagaaaatcaagataatattttgagggggaagaaggtaaaatcaattaagacagggtgcacagagtacttgaatggtacagataatgtttatcctttgtactaaatggtgtgtatgtgggaattggttatattattttgactgtttgtagtcatattatatacatatgtgtataaataaaaataaaagaaaaaatataagctaaatttatagatatattaattttatttaaatataacaaagatttgccagtattcaaatgtctgcaatgattcttaaaatgcacagaacctgtgtttaggtacagtatcactgttcatccagccttcattcactcgaatctactcttacctaaaatttgtaccgtaagtaaattacattctgtatgacagaaagcaaattacaatattagaacaacattatggaaaattggcataacattgtacaatcatccattactttattatttatcattttgcaaatttttattatattagtaaaaaagtctaactgtacttaatagctaatacatatattatttgatatttttaaagaccattattaaaataataataatttgggggtgagaaggcctattgaaaaatgaccaacgtggaaatcataaataagtttgatgcaacaaatatttgtgagtcttatagttaaaaatgtaaaaattcattataaacaaagctaaaagacaataatatgcattgggaaatatttgcaacatttacttcaaaggtggatgtccttaagagaatttttacaaattaataaacatttaaaaaggtgaggagtggcaatagctatgagagacaatttacaaaaacataaaaaatatgaaaactgtttaatctgtaagtacatcaataaaaattttattattgtagttattttatctattaaattaggaaaggtcaatacaattggtaatcttccaagtaaatataggagagaaggtctttctcatacatttataagaatattattttgttagaatgcaattaaataaacacttggtaaaaatccatatcctttgtccaaacaatttaagttctagacctctagaatccacatgtacatatacatatatacatacatatacacacacacattcacacctatatattaacaactcaaatccaactccaactcttttgtaagtagtattttgtccaacaaataaatttatctcaaattcttcttgacttttctccattatagagccagcaattctacgtgtaactctacctctaattcctttatttgcatttatttctgctttcaaacccttatatgaggcaagtgggattaatttatttcattaccttaactagattcatcgctttactttgtcaaactctgattgatttgctcaactcaatcttatgtgttcaagaacttaatgtggattcctgttccaccttatgaaagtcttttccaaaaacttgctaaattcttgactcaagacattgcagtcagtaatgcatttctctcctcaaatacaatggaactgtgttctaataaatactcttcaacaatgtgcagttatttctccacaactatcaattccccttaaagcagaattttactaaaaatggctttatccttctggggataatcagtaaaatggcaattggtgggtgaattaaaaatatactaaaagcagatggcagaacatgagtgcagatttttactacaaagcttaggaaaagcaaaaggaacttgaatagagaaaatgcagaaaagccctcctttggctattaggacggagagagcagaagtatgtttagagcttcaaagagtctgactctttgcaactgtttatcttaggactttaaggaagtaaaaggtgcaagtgaaacactctggattataaaatagaatctgacacagaggattcaacccagttaatatgcatgttgcttacatggaaatgctgagaaatttttagcaaatagatagaaaatgacagatggtaggtatatagaaaataattgtaggaaaaaatgtaaaatgaagatttatggtattccttttatattttattttgttaatatgttgcccataatgctttatttcaaagaatgcaaaaccaaaaaagtagttccttcctaacttcccctgcagccttgtcttgtggagcttgtattttacttcatgagaaatgccaaggagatgtcatttaagctgaaacctccagcagaattagccacaatatttgggaaaaagatgtttccagaaaaagaaagagctagtataaatgtccttaggcaagaaagagctcacgatgattgaggaacaacaacaaaaaagattatttcactcaagaaaagtgaattgggagtacagatacaaatgatgaggtctgaatatgattcatggggcaggtcacactagggtgtttgggtatggtctaaatgaatgcgcggcatgagttgctttaaggagaggagtgacatgatttgacaagttcttaagagatccctttgattactctggggagaatagaacataaagtagcagaaatgaaagcaaagggagatagtaggaaataattgcacatttataagcaagaaatgatgttggcttggactctggttatagcaacaaataaagaaaaaaggaaatactgagaagagttgattggatttgctgacattctcaacataaatggaagtcagtatttttttctaataaatataatatgcgtaaatatttttaaatatttaattcttttaccactaatggggcacgagtagacttcagggaacatgccagtacagaaccatataaatgtgatcattggtagagataggaattaataggcatttgaatgtctccctcaacctggaataccacaaataaagctctttgcttttcatgttgcattgttatcataccctatagttttctgccattttcagttacttaatattatgttttgcctcaatagattatagtgctttctcttgttgtgttatatttgcagcaattattagtgaagttttaaacttcaatatcacatctaaaacagagcaaaattgttgcatactattttccattaaaacatgagaccactatgacaaaaaaagctaaacgtgtcatgaaatgacttacattggatgaaagtatatgcaatatattaagaaataatctctgactttatagttttttatttgtagtttttactagaacgtgaaatcaatatgtgaaccctggctggagtttgcatctaaatgtaataaaataaaagaaagtttaatattatcattgaagcattaatgtacattagcgagctggactatataaaataaactttattatatttagcatttgatttttatttatgtatattataaaatgaatatagtttatattataataaaaataaaagaagtagtatgttaactaattagtataagatgcctacaaactacatatctgcctaaatttttgacccatgaaacttcaatgatttgtgttaatgttaaggcctacatttatttatatatatatataattaggggaggaattgttaattctttcattttaaaaattttaactttgcagacaaagttgactatacctgtggcagaacactgcaacagctataaataaataaataaataaataaataaataaataaataacttttattttctgtggagctcccagaattatgaattattctgtagattgagatttgccaaggtccttttcttagagttgcaagagcataggagaaagtcaagggaaataataagcagcacttgatttcctttaccacagtggatgggcttctaaaaccaaattacctgactataaatccagatctatcttctgcaggctatgtgattgtggatgttacctcttctgtgcttcaatttcctcatctgtaaaatggaattatagcctaccctattttgtagtatagtgaggataaatagaatgaatgtatgtagttcttagaatagagcatggcacgtgataagtggtcaataaaatattgtttactactagttatgtaacagtcacttcacacataataatgatttaataaaggaataagaagaatgtagagcacagcttctcaacattggcactatgacattttgggtcagacaattatttaatgcagagggggctataggatgcttagcagtgtctctggccagtagtgtacctcctcctctccaagttttgacaatcacaaaggcttctagacattgacaactatcccctgaaaagtaaaattgtccctgcttgagaacacaaatataaagtaaccactcaaagattacattactaattttaattgaatttgaccagcattatgaaataagcataagcttaagtttctacccttgattttgtcattgtcagttagggcagcagagaactccaattctgaaaattctgaacatgtgctaataccctataatataatcaaaactttcatttttgaattgtatttcttaaaaattagaaaatttattaagcagcaacatggaataattaaccacaaaaatgttgaacataaatctcatttgcctaagttctcttttgaagtcctgtttcactatataagtattatgtgttttgtttcacagctagataacagccagttttttctctgagcctaaggttgctcctcaaatttatggtggcttatagctcttctaagtttctataaaacttcagcaacctgcagcaggttgaaatttattgatattgagttattcaccaggtcatattacaaagtcagggactgactcacccaaaccagatgctccccctgccaccagatcactaggagatattgcaatcatttcccctggctactaaattagcaaaaattctcagggagagagaagggcaagatggcacagtttaatacttactattattcttttattctttatcatcattccctttgaatggattaagaatctgacataaatataacttgctaaagaaagggtgttaggtgagagggaagtcatattggtctaagaaaagtcttagagaaatatttgaaaagaggtagagagaagggttggattggagtgggtgggtggggaatcacactaaggagatggatcattcataatttctttagacatggtgaggcagccacaggagtctgaacttgttgaaaccctagtctgaagccaataaaagtgctcaataaggtcacactttgatcttctctgcctaaagcagttattcaccctatctttgggagaggaaacatctacaaacctttgttctctttgttagcagagggatgacatgaatttgggaaaaacgtttgagagacaaaatgagatttagctcgagcaagtgatcgacttgtgctgggttgcaaatggactttttcaacaggcaggttgaaactgtgcttcagcaattaggataccagatataaacatccatgcacagaattggaaaggttcagctttcatggttgctatggtttgaatgttccctccaaaactcatgttgaaacttaatccaaaatatgacaatatagagaacgagctttttaaagaggggattggatcatgaaagttcttccctcatgagtggattaatccattgataagtcagtggattaataggttatcttgggagggaaaccattagatttataagaaggggaagatagacctgagctagcatgttagcatactcagccctcttgccatatgataccctgtgctaccttgggactcttctgagagtccccacaagcaagaaggctctcaaaagatatgccccatcgaccttggatttccaagccttcttagctgtagaaaataaattcagttctttgtaaattactcagttttaggtatactgctataagcaacagaaaatggactaagacaatggtcttatccagaactttgtaaactagaattggctgtttagattcagtatgtattttttttatagattcaaaataattttgttttgaactgtacaatgaaggagtgtcataagcttttccacatgtagaggctctaaatatcagtctggcattgtgataaagcagagagtttaaacccaatcctatttgtgccccatgaccgttctttctggttacagttcagaaaagtaggaatggatgtgtaactcaaggagaagcatacaatacatgaagctttttctcaaaattttgatttagaaaatgaggtattttagtatgttaattataggcatctcaactgagaagtctaatagcattgggccagaattgtcgcagcagtccaaagccatggataaacttaagttaaagggagcaaatactaacagccttccaaattaatctgtattggagaagatgataaacagatgaatgggaactagaaaccatgcagacttggaactagatataaaacaaacagctatctaatgatttcttatttactctgagcccaagatatttttgtatccttttagttaaacctctgttttactaaggaaatttaaataagattctgtctcttgcaagaaaataacatctaagacatcttcgtatttaatactgccttaattttgtttactccagtggtccccaacctctttggtaccagggattcgtttcgtggaagacaatatttccatggacagggttggggggaaggtttcgggataaaactgctccactactcagatcatcaagcactagattctcacaaggatcaaactagatcacttgcatgcgcagttcacagtagagctggtgcttctgtgagaatcaaatgctgccaatgatctgataggaggctgagctcaggagtaatgctcactcatccacctctcccattctgctgtgtggcccagttcctaacaggcccggtaccagtttgtggcccaggggttgggacccctgttttacactataacatttccacacgtctctcatggcctttcagatccactgcttgtctcaactcaagtccagctacctgaaaattcgattattttttcaaagtgaatttgaatatctttatgttgaatacacagtctccacttttacgcagcccctactgtcttctatcatacctctctagccctggaagagatcaactttacattcacttttcctgttttagggctattattttatcttcaattaccaaaatctatctacatttagatactttaacttgcaaatacatagtaaacaattacagattatttaaaatagcagttttcccatgagtataaaaaaaaagaacaataaaagcaatatttgttgagtattttaaagtgccaggcactgagcagtgtgctttgcttaagtaaatgtttgacaaaataaaaggtcctttaaaagttccatgctttaacattaataaccatataaagataaggttagacttcctatcaaattagcagttttgtgaagataggccttttctgctatatagaatctcctcaaacctgagtgttcgtattatggattatctagtatactccatagctatcaagtttgtgtatgtttctttctcaagcaagttatcttatttctccttatttcttcagacttatcctttcttttcttttcttttcttttttctttttttttgagacagagttgcactcttgttgcctaggctggagtgcaatggcatgatctcggctcatcacaacctctgcctcccgggttcaagtgattctcctgcctcagcctcccgagtagctgggattacgggtatgtgccaccacgtccagctaattttgtatttttagtagagacggggtttctccatgttggtcaggctagtctcgaactccgcccgcctcagcctcccaaagtgctgggattacaggcatgagccaccgagcctggcccctaacctctcatttctaaggaaatgacaaattaagtcttttatgcaaatacagtgtagggtcatttaaaaatattttttgtaataggtgtctctgtacataaatctatttaattttttctcttttacagtaaaaaaggcaatactgtgttttagtttcaccaaaaatttcagtagaccaattgtgtaaagggatacatttatatgaatttttttgacatagtaaaaactaagaggggaagttattcaaatatttcagcataaattccctttccttgaaattgcaatcgtcatgtgtagctacaattcctcagcattcctctgtagtataagtagctacaattcctcagtataagaaacactaaggtggaaaattaattgttaagagaacaaagtcataacaaaacaacaaaacaaaaaagtaggatatagaaacattaactcaatatcactcttgaagctcacataagagaaattattgtactagacactgtggttcatcatccagaccccatcttcatgggaagacatcgatcccacactcatggggaacatcagcagctgacaattcacacctgtacctttcactaaatattgtcctaagacaaactaaaatgaactaactcgcccaaagtggtgcctcctttcagagagcagccattgacccatggctggctaatgtagttatacaaacatgcaactgctttgcatcaatttgggacaactctgaaagaggcccagtaggattggctgaagactcagttcaaagttgtcaaataaagcacaccatgcccagctgaatttacattgtttactatgagtatatcccacgaaatatttaggaattacatatactaaacattattcatgatttatatgaaatttaaattcaactgggcaacttgtacttttacttggtaaatctgggagcttttccttagttgcatctgcatggcaggtaagcatgtcggtatgcccagacctcccttctttgcttccttataagtgcgtcccagaaaacaagcaatcatctcagagccaataggcattgaggcttttgataatcaaactcccaaaggtcaaggaaaaagagagtatcccaaaagcaccaagagaacaaacaaacacataacatacaatggagcttcagtatatctggcagcagacttttcagtggaaaccttacagccaggagagggtgacatgacacatttgaagtgctgtttatgggtcccttcggattgtaacggggaaaacaagaattgtagcaggaagaattaaaagaaaagagagaagctttttttttttttaataatctgatctttttctattgagaggcaggcacccaaatgctgcttctgtcggggagtgaatctgtaaattctttgtaactctgtgctacctatttgttaacctgtgtaatttgttctcctgctgacttcttgcaaacacttgccagtgggtatctgaagcctcttacatcttctgtggcacggacttggcctatatttagcatattcactcatctaaagtgggaagaagaatctggcatcttttctctttctccatcttgccatcaaaagctgcctcaatgagcatgtagccttcagaattttgaaagcaagaagcaggcaacaactggccatgtttagcttcatcttgaaactcttgaggacacctatcaaactttcccaaaactgtctcatcatgtatggttccattgcaggatgggtgcaatgctgagtgccagaaggagagggatatcccattctttccttcttaaaaattgctcccagtctttttgagctctcttcctgtttggaaggagaactaaagcaagtttagttctccttacaaaagagaaaataattaaaagcactctcacttaggtaactaattcactttctatatgataattcttagaatgtctagtcctctctttacataagagtacaggtaattgaggtcagtgaaggttttagttacagaactggtctggctactttttattaaaacctgcaaagacttaactgttcttctataatttagggatactcatcatttaatagggaataaacaaaaatttgagacaaaaggaaattctgtatccatttcatatatatacatgtaaattacatatagaaaaaatggtttagaagaggagttaatatcaatttaaaaacgggaattttaaagctgggaataatacatagcataaatatgtataaggattcagcaaaatgttagttgaaacagggggctaaataaacttgaagtttaagaaagttaagaaatgaacccaaatatgcataaatctgaggacaaaatttgatattgctgctaataaacaagggaggggcatcatattgggaggcttcattaataaaagtaacaaattatgagaacaaatagtcttgttatagtttatctggtgaagcattttaatgaggcatagctgtctgttccattaccgaacgacttttcttatgtgtgctctggtagattttcatatggctacactgaaagatattcccaaatgtctgactaataactctatctataggcaactgttctgaaggtttaaagtaaggaggatggggttcatttagaaccagtgggaaaaaatgctaatgctgggctttgaattttatggatgctgtagctgttatttttcaattaaataaatgttttatatgccatgttttgtagctatcgcagttaaactgccctcatctttttgcccagcaaaaaacccattaagatcttcactgagattgagtctaggtttttataaaattaataactttgctactggtttctcaaaaatgagtagaaatgacttttcaatgcaaatgccagtttttgatacagtgaaattatcctgtctgcagtgactatttgaacttttatcggcaattggacactgagagacttagtatatgaacagatttatccttagattatctaatacatgctttgcaccctgcaccataaaacccgatctatttttaaagccttggttgttctgaaaaatgaaatgaaattgtattaaatggcattttgactggggagaaaaaaaaaaacttcatgtggtttaagagaatggatgccggcaattgactgtctactgtttattcaaaacttatagattagcagccagatgtggcagaaagttggctgatttttcattcacaacaaaaacgatgctgtgcttaatgaatggaggtttgttatcccagtaataagtaaaaggaacatgaaagcccttgtgtttaatgttcatgcaaataagctatttgcaggtggcttttgggcagggtcaagtattttcaaatatttttcaaaactgggtcaagttttttaattgtcaaaaattaccagctagaggaaaacctcctaaaaactttattatgctatttcccaagtaaatgaaatgacaagtcacttatcatttaaaaattacatatgaaaattcttttccttatgatttcgtcaataaataaattctagaggattctagatatatttatttggcatttttttttaatgtggtatcaaattttgtggacattctttagagaatcaaattcttaaaatggcattgaacatttaatttaaaatgtccttcttgaaccatacatgtttattaaaaaattattttatataggttatccattaaaaaacaattttctatatatgtaaacatttatgataactgctcattattttggtccatacttatttatctacctatttattaaacaatacaaatcatacgctttgtaaaaataaaggcctagtctaatattactctctgtcagaaataaaataattcagagaagtctgtattagaagacaaaataaaacaaaacagaaaatgatgagaatcacaaaaccattgccaaatttccagctatggcatttactctccatgtggccttaggtatcttactctcttattttaacctttctttgattactgtaaaaataatttgttactaagaaaccctcttgctttagtagctgtgagtataaaattaagaacataattctcaaaaagtgttttagtcttcctggaaacattttaaaatatcaattaatcattgaacaatacacaatcgcctgatcatttgctaagagagggttgcattctcatctctgttcacttctgtcctttctgagacttacacaggtatgagagctagaaaaaatattaatgtgtagtaattcaaaatttctcattcatgaatcacttcagcagtgcaaagaatactttgtaatttttaaaaggcatttttattaatatacttctactattctaccccaatcaacagcaaatttacctaaatcatgagactactggtacttctaatttttagaaaagaatgacataaactgctaataaacccaatgaatcctttacccgcaatgagaatgtccacgagtcagctcttctgaccctctggccagtgttctggagttactgatctccaactttctaattgaactctagcttggtatgtgagagcagccatgggtgaaccagtggagcaagatttaagccttgacattgccattaatgattcaccacctgttgcaagttcaataagttattcacacaccaaattgtggccgcaaaattctgggagataaactaagttagaaagattgggggtgaataaatgtttgctaaatcagaattgttaatgatagaaatctgtatcttaacaaagttgagaaatcttgtcttcttaacgtgtatttattgacttcccaggatatgtcttagtgaggaaacatagcttctggcatttattattagagtgataaggaataataaaccacagtgcttgagagacagggaaaggcagggggagccagagacacagtaacagaagcagattaattgactgatgaaataaacttgagataagagagcacagaggaggttcaagagatggaaccatatattcctctctatctgctcccaacatcaaggaaattcatagcatattttataatgaatccctgataaatattagtctataattgaaaatctattaaaatgactatttcttagggtacacaaaaatattacaacaaaacaagtaaagaaaagttgccatgggatggaatattatattttcctgcatgtctgcttcaaggcagaatcctaatggtcatgtatgtaggtaaattattctttttacagcaacttctgggaggtggtatttggtgcagtataaaaggcaaggggtgtagtgagggtaaagcgtaagtactttgatcttgagccttgactatattggacttgggatctcggaaatcttggggataagcagtggattaaatccataaattagtaaagtgttgattatacaacaggtagaactacgtgccacttttggagggacagtcttcttttttaaaaaaaacaaaaggccttaaaggctttatgtatatataaagccttttttaattataataaatacatttttttaatgaaacaatctgcacatatacaattccactctcaagaaaggcaattatttacataattatgcagaaattcctataattatgaaaataattgcctttcttcagagtggagttgtatatgtgcagattgtttcattttaagaaaagaaatatttactgatttgattaactgaagttctggatgcttaaaaaatgattaaaatacacagatctactatctgtcttcatgaactttaaatgtcttgtaagaaattcaagtaataaagactacaacatttattatttaactggaacatgtattatttattatcctaactgtggttaggaagcaccattatttattatatctatattaatcaagttgtatcctgtaacaggtttcctgttatccactcatgtcttctaacttctgaagtattgtttaaattacaagggagaaacctagacactacattttctaggatctcaggacaatagagctccaggtgaaattatgctaaataagggcatgagtgtaagatgtggatgtcacagtgaagagatttagagcatttttctggtgacctcctgtttaggtttgacaagcatctaaaatcattgttagcaactttcccataattattgcattttcagcctttatgaaaatagcagcattttttttcctttctttgcccatgcacaccatctaatcatgagataagtctccttctgagtccctaaatacatgacatacatagattgggatctttttctgacctgttcctgtctgatacattcttcaactctaagatgagttcatactcatcttctgaagcccctgggaaatggaaatattttttcatattggatgttggtagagacccatcatttaatgaacatttatgtgccaggatttgtacaagacacttagatacattattcatgtacctcacacaaatgtatcaacaacacaacaaaatgtctgtatgaaataataattattatatcccttatatggaaacagatccagagaggaagatacactagcatgtgtaaatagaggattcaagtattaaacatccatctgtccaactgactacaacctctttcataaaatgctaatttctctcctgcttctaattttcttatcaaaaattgtcatctattgttattgggtctatgggtgggtagtgactccttggtttccattttgttctagcggattactgtcttctttatttttgttctagtgtttattgagagtcctaattaattaacctggctgctctgacttccatcagctcaccattgtctcttctcccagctcataatttctgtaacagagctctaggctatgctgaagttctgctatatgttgccagtctctctagatccaagtgcctcttgtcggccaagtttacatgcacgtgtttaaaatcttcttattgactctatatacaaagtcttcacatgccttcctccttaaaataatagcattgtgagaagaaaaaaaaaatcatcattctttttaaaactaattcaggatgtctatgttatacaacaacaagacgtgggggaatatttacctggtagttctgtccctcgttatcattctcactcattataaaattggtatctgaaaaaaatcttgctgcaaaaacaaaaaaaaaatgtatagggtataaagaaaaagtttgcttcacatcataaccattacccatcccattgccaaagggaagattgtacactacatgattccggggagcagcattcacatagactatagtgtgcatggtacatgcaagagaccccatagtactacccgctttgtcctccttgtagacatgctcacagatgatccatgctccctgacctggagtagtcaaataaaagagtagcatcaatttattaagattctttccagaccattttctaggtattcccattatatattccttcaaatggaaggattttattctgtacatcacatctcactgtacacatttttttctgaaatctgaaatctgagtattttaattttatacagtttcaattgtgagaagtacctgacagactgacctgacctaacactctctaagctaaaacactcataaactagcatagaagctttacacatttatccatttctctaatttacttatctattgtttcctgaaacatctattaatcttgcagttatttgagatgactgtgagcttactatttgccagggatggcatgagcaccttggtttagtctagtgcctggcatttattttcctaaactgtggcagcaagtttagctgtaagcatattttttatcagaacaatcatccatctttaactacatgtgaggaaagtactttcttatattgcattacacatttttatatggccacagaaatccttacttagtctgacaaaattatggtagatttctttctcctaaggtcaaggaaagaatcattctgtactgtttccatggagatgtttctccttttctcaattgccaattgtctactgtgtgtcctgggttccttcttttcatatgtcatgaggattctcaccccagcattctgctcctctgagtcaaagcccttgactttcacttctcaattgttttgtttgcagtttttttgctttcctttatttttcttactctataaatgctatgaaagtgtatgtaaaaatttacccatcttttagtttatatttgttatcaccctttattcatataccaaaccatataggaaatgaatataaggagatctttcttagtaggaggtagaagtaaaattttgtttagaataaaaacagaaaaaaagagaataaaattccatatcaccagtttgcttctaaatgcccaatgtttccacttatgagcttgctactgtacacaacgcaagggcttgtaaaaaattgtctaaatgatagtggttaaggacgtattttaggctaggttactttaaaaaaatatatcatcacttctgccgtcaaaagtgaatttgatgtatcataattgttaaagttgaggagggtcaaggattcttctcattctatggtttccttataaatacactttctaataaatgcctaatttttttctgtgaaattaaaccattagatattgctgaatgtctgtatgtttcttacttttctagaatctcattcttaattatagttttatatttttccttcaacaaagtcttaaaacccatgcagctggtgtctattatttacattctgtgatgtattttatttgactttgtgtttttagtcttttcacagaaatccttttattgtgatcttcttgtccaaaagcacttatttcatatctcttttccatacctatcttcattagcaggttgcatttcagtttcttcagtccttttttagataatatattttactacatctgtcttcacaacactgtatacgctctgatgatcaggtctcccttcttttttttttttaaattctcgtcctctttgggacccgtgacaaagtaaaaggcagatttttttctcacctgacttaaaagtaaaaaggtggccgggcgcagtggctgatgcctgtgattccagcactttgggaggctgagaagggcggatcgcgaggtcaggagatcgagaccatcctggctaacatggtgaaacccgttctctactaaaaatacaaaaaaaaaaaattagccgggcatggtggcgggcgcctgtagtcccagctactcgggaggctgaggcaggagaatggcgtgaacccaggaggcagagcttgcagtgagccgagatcgcgccactgcactccagcctgggagacagagtgagactccatctcaaaaaaaaaaaaaaaaaaaaaaaaaaaaaaagaagtaaaaaggcttcatatgtttctcctctgattcttcttaggcccagcatttccaaaaacaaaatagtacacaaaacattagttgtaatgatacttcaaaaggttcaaatactagtttttggctgctttctgactatatttttcttctaaagaaattttgttatgaagtattgaactattcagtatactttaatattttccaaataaagtttccaaactgatatttaacaatattctcttatattcaaacatattctgaactattttctgctgtgtctctagatcaatatttataaatctagattgttcatgtattttttttcctttgctaactttcaagatcatatcaaaaagcaccactgttgattccattttttatgtttcattatttgaaactatattgacatttttcctcttctttatcattccctgttatctcatctttgtgagtcttccaattaatgttttttcctttgaattatttattttttaactgaaaataaattgtatatatttaaggtgtaccacatgatgtcttaaagtatacatacattgtggaatggctaaatcaagctaaacatacgcattatatgcattaccttgtaatcggaccccttgaggtgtcaatacctcagcatttttagtgattgagataacaaaaattcgaattaggcccttgcttgcttgcataaaagccaacatcccttgttctcacaatacaattgcaaactgctgatttactatttctttgtcaaccaggagaagataactttaaggtaacaaaaaacatttgcagaaggaatgaatgcctataaggatgttgcaactaactgctgaggcccagaagtctggttgctcaggatattatcagagattaaagaaacacagactttccccttggttccctaaaactccccctctcttactgtctagctgcaaaaatatcctctctgcatttttttttttttttttttttttttttgagacggagtctcgctctgtggcccaggctgcagtgcagtggcgcgatctcggctcactgcaacctccgcctcccaggttcacgccattctcctgcctcagcctccctagtagctgggactacaggcgcccgccaccatgcctggctaattttttgtatttttagtagagacggggtttcaccgtgttagccgggatggtctccatctcctgacctcgtaatccgcccgcctcggtctcccaaagtgctgggattacaggcgtgagccaccgcacccggccccctctgcttcgtcttattgttaagacatgtctgagagatcttgccccgttctcactttggccaaatggaataaacttttatctatccccaagcattggtgtgtcagtgtttggtttcaattgagcatcaggtacatgagcccgaatttgggcctctacaacatcttcacctacttactatattttgtgtgtgtggtgagaatacttaaaatctactctattggcaattttcaaatataaatgtattgttattcaccgtagccaccatgatgtgcaatcaattttttgaacttactcctcctggctaactggaattgtgtgtcttttgaccgacatctctgcaatttccccatgccctagcttctgatgactaccaattaactgtctgtttctatgagttttacttatctaaactctctatataagtgagattatgtcatagttgtttttaagtgcctggcttatttcacttgatgtaaagtctcccaggttcatccgtgttgttgcagaagatttcttccctttttaaagcccattaaccttttatagatctggtactgaggcaatgcaagcttattggacaattatatgttatttgaataaattgaaacataacagcttataaagggtcaaatggcagttaatagcctaagaaataggtttggaatattatttcttagcataaaggataatattggtcagagtcttctaggcttgaattcttggctacttagattttatcaagtaaattgtaaaaggatagtcaatcacttttttcacatgaattgctgtatgaatttcgacttgacaagaaagactgtgaaaacaaaaccactattatctgtgaactacctaatgtggaaagaaatatccttaaataaaactttgagaaagtagattactcaattttttcctacagatatcccatatattgtaactaattataatatttaattgaatacaaaatctttcttcttaaggaaagattttattcagttttagaacgttaaagtttctccactctaatatatacagaacttctttaacctttaaaaatattgcttcacttattactcatgataattgggccacatacataattaaaacacaccatttattatttccccttgtaaaagtggcatctggttccccaacttaacttcaaactgtaattttaaacaaataataaagtgttttgaaacattaatgtggttaattgtcttatctattgtctatgttcatcaggagctgtgacatgcccaaaggaaggtaatcagaggaaggaagagaagaagctaagttctagagaatccattaatcatggtttagatgactgaccattttattattttcattttccatttaaaaacgttccatttttaaattggaagggggtatgttttagaatagaataacgaaattccctccatctcctcgtagtgtacgtgattaagaagaacctaacagaaacataaggttctaaggttcttgctggaaataataatcagaactgtaagaattctcttatagaaaacatttaaaaaaggaaattctagcaatagaattcattgttaaaactgtaagtcacaacaatattgtctctgcatgctgactgtactcctctgtaatcttcaaaggcaaacaggaacagtaataatcttttcatgtactctcaacttccttctctgaaaggctagaaaatgtcttatatgtagcactcatactgtcatttaatcaaacccagtttctatttttcttcaatttctagaggaatggctacttagtctttctggcataatgtgaatttcttaagtgtctgtagactacatctcctatttttacttcttgaagtttctctcaaactgtgataaagagtgtcactctatcggtactgttaataatgtaaattttgtttctctttttgttactgccaagattccactgactgttgaaatataaaagaaaaacagcattaaatcaggtgtgataaaatcacctttttctgtttatctccaccactggcatttattggcacttggaaactatttataaactcatactcttgtaacagtcttgtagctgaaacccactggattcaaaatctattcctagtacttaactttcttctgaaaattccctcatctataaatttgaggatgatgataattgcaaagatgccagggaaatttataatcattactgaactaatccttttgaaaatataaagcagcattaaatgttacgattactaatctttttaattaaagtggcaaatgtgtccaaaaatctgtaactaagttcattactctcatttatgcagctaaacttaagttctaccaaatgtatttttaagttgattaaaaatatggttggcagcatttataaatacccattattaacatgctatactggtaaatatatttctgctcttatgactagagagtgttgtactttagtaaaaaaattatacctcaataattatctgctctcctatttttattttatttgcaatagatatgtatttattcatgcatttgtattcttattgaatgaaggatgttatgtcacttgcattgagtacataggcatccctttcgacaaataaaatcagaatctaaactacagaaccaggttcaagtggggacagaagtacaattttaataaaggtcaaagttttgctagtgtttcacttaaaatttatttttaggctttctgaatgttctcttaaagaaaaagacttaatcatatacgtacttttttgtattgttaacaaggaagaaacatactaatatgaatggtactacatacattatacatgttatacaagagaagaaaattatatattcaagataaacatttttataatcacaatacttcaacataaatgtgttcaatatagtaaagatgcaggttgtataatttgtcaagcaaattctcaattatgtttgaattctatttaaaatcaacattagtattgacaatattcatatttaaggctttttaattatttaaataggttcaagtttgctgtgttcagcattattagttgtaaaagtaggctctggtaccgaaaatatatatttttagctcccttctgtcagtctttccattaaatgctatagactcacagttttacatgcttctcagcacctcactgctcttgttgcctataatattttattagtttaatccttctgaaataatcctggtcattcaaaaccaatacatcaaaatcttctagagtgaacaaaagaaaaaacttttgtgaagattaaaagaaaaaggagacttctcagatatattaactttaaagactatatctcacaattatgtaatatatttgttgctttatctaattagatttgcatttcttatatataccatgcatataaaaatatatttgatacaaattataatacaaggcatacaaaaatagaccattataataacagaacattttctaaagggattttaaaactgtaagccaaatgccttaatctaatactacttctaaaatgtattctaaagaaataatcttgcatgtgtggttagacttaattacagaaatattcattgtaacctttctttagaagtgaatattgaaaactgaaataaatctaaatgtccaactttataattgctagttatggaatactaacaaatgaaatccatgcttttaaaatagcatttagtgaagcaaatatatgttcaaaatacatataaaggaaaaactggtatgttattaaagaagatagaataaaatttattttgagagtgtatgctaataagacagttttgatatttaggaaaattaaaatgttaggtaatattttaaataaaaaaataaattttctgtttgctgagattatacgtattttaaacaatttttaatgtacgctatagacactgaacatgtataatttatgtatcaagaaaaaaatcaataagttcaatttttaaaatcaaaattaaaagtcacataatagatcagagaagataaagatgaattacacttttttctttatctaacaaaagagagtgcatggtttatggagacagacaatttttttctctggttttaactctaagatataaaaggaatctattgtatacatctggaaataagaggtatttaatacctaatgtatattaagattactgttttagctttttttttacaatatagaagtactgtgtgatgacttaccttatcaaccattgaaagagccattttcaaagattgattaaaatcgaagagttccataagcaattttcactaaagcattgaaaactattatccaagattaagaaaatacttttctagggatccctcatatctagggatctaatgaccattagatccaccttgtataatggaattaggacaacccaaagatctggatgattgaattgtcatttggggattattaccatcatacagctcagtttatggcaatttctatacatgtgtttagtattaattgaaggaaactcataggaattagatgccagacatgaagactatatacatatcttcagagcgcttgtgtcctaaactgaaaagtgtgttttaagagtctgggatatgaaaccaccttttctctattcttgtcaaatccatgtcattctagctactgacataatttatgcaatataaatacaaataataataagcaaagttatatgaaaatatgtttccagtatataggtagttttaaccattctttttagaagaaatgtgtgtgtgtgtaaatgtcttaattgttaaaatgattaagtcattcacaggtttgttaatgtttttccatgtagctggagtgataataatttgtattacattttagagtggtttgatgcaaataaataagaaccaactcaaaatgttattgaggttaaactccaagaagacaaaaggaaaactaaaataacaaagtaaactataattaaaacatttcaactaagaaaaaagtaaaaagttaagctatctcagacaatgttcgagattgaagcttgttaattgcaatggaaaaactgctaattaccacaaatagtaatttagaggcataaatattacacaggtgtggctgcaggaagttgatattaatcaaacacatttggcattttcaatgttgcaaaaattacaattgtaaacaccttccatacaatcaaatgttatgtgaattttaaatgagtctcaataaattatactgcataaaaacaggatttttactatggatcataattgttaatgtcttccgtactcaaggttgaaatataaatcaattcactctattatttggtttggaagtttaagaggacaattcacatttcctttgatacactctaccagtgtcactggactggtgatgtgacaagaaaggtcttctgtagaactgaattgcaataatatggagattataacaaaattatatatgtacctaagaatattgactttaaaagccttcttcagattgcaacattgatttccagatctgttgggaactagctgccttacttaatgtaacagtcttggcaatggaataatcatatatatcacccatggataattaatttttaatcattgaaattcactgaaatatgttgaacatgaaaattatacaaatataattttgtatgctgtttcagattctttggaattttattctaagcatcaatcaagatggtatagtacgagaaaggtagaacatgtaattataaattcaggattcaggaagtttatttttctcttctttttaattctctcaaaatgatcttgattcctgcaaagtgttagtgtatctggtaagtaagagtctatttcttttaaacttcatctgtattaaccagctttatatgaccaaaatgtcccccaaatttaaatctttgcacagtaaggccttatatgtacacctggcctcatttcaaaagactaaagcagttgttctcaaattcagctgcacattaatataaactggaaaactgtttaagctcctgatgacaaagccacatgtgagactaatttatgctgaatcactgggccaaggacccaggtatcagcattttttaaaactatagaggaataaccagggttgagaaccactgcacaaaatggtacatgcaacttttatttaagttattttttttaaataaataatggttgaatcgatattgatcttagtaccaagtcatggcaattttttcagacttagagaattcatcctggcattgagattattaaagaacctagaaatccaagtgtttttgtttatatttttcctgtaaatattagagtatgctagtgctcatccttatttgataattttggaaaatatattaaacatttgagattgaatatcaaaaatctctaaaagaattttagaaataccattcttctatgaaataagtaagctcaatcaagatacatattatagtgcccatttaagaaagtctaataataatgcttgcactgcttaaagattaggttgataaattaattattgttaatcctacttgcataatcaacggacacctagcgatggagtcttaagtatagacacagaagttgaatacttttaagaacttttaaatttacatccgggttaagttttactttaaaattatgttgagtggttgtgattagtacatgtgtgattagaaccgtctttctcaggttattacatcatcatatagacacaggaaaaataatagaattaaaaataaagcaagaaaaataatgtaacactttattggcttcagataattattttgagattctaatcctaccaaaacattctgcttttcttaacttgatcctacttttgtttgtttgttttaataaaggatgaaccaatatcctgagaaattttcaaatagggctggttataacactaagaacctagatctcactatgttttagaaaaattgtaaagtatttcaaataatcagtaaagtttcagctctgcaccattgtgtctttgcaatatggggaaagtcacttcacttctctccctctctcgtttttggcacatgtaaggcagagaaaataatatctactccagctatcccacatgttattataaaatataataagagatagaaaatcactttataatgttcaaagtattataaaagtaagccatgattatatgtgggattaacagcagtttgttatttaccatttaatgtattcctaatgtacatttttgccatatttaaaaatgtttacatttcgatttttaagtgaaagagtaacggtatgacattatgccatgttatatctgatgccattatgtcaaacaaacaaacaaaagcattttaaactatttggaatcttaccaaaataaatcttataactatgataatacaggtttttgaggatttagtttgtacgcaaaaacagaggcaataaaggcaaaaatagataaacaggattacttagaattataaaccttgtgcagagcaaaggaaacaggagggtggagggtggagaggcaacctacaaactgggagaaaatatttgcaaaccttatatctcaatgtactagtgactatcaccctaataactagtcatgggagcactgtcatgcatttggtatgttttagttttcgggatgctgccacttaccacggcgggagcctgatccctgcggaatcgactgtagctggacttatcttgaatattctgagccaacataccaaaccataaggtgctaattcattcatgcttgaaggccataataatcaatacacattcacgcacacatgtacgttcacgcacacgtacgttctcacacacccgtacgttcacacacacacgtacgttcacgcagtatttaaaggagtgcttccgattaaatccgcagatctgccctccccccatctctgagtttattgttaaattaggtaagccagcccccaaaaacaagatacttaaattgaacctagtcagagccctaaaaatcataatttaaccatgaacactccaaccctagcccctcgattaacgtaattttctaaaaaatcctaacattctccaaccaaataaaatctcctatttcgatgctaactaaatctctgtcctaatacttatataatacttcaggtatcccgctctgaaaagcttgtatcccagatattatagtcctaaatcaaatataacttcaactacaaatggcccctcagcgaaaacctctgctagttcaacttttttaaaggccctaaacttccaggactgtaaaggaccactttagatttatacctaacaagatcctaccctgacatccccctagtatttcaaaataccactcaaatgtttttcacccagttaatgtagcttaattatttaaagcaaggcactgaaaatgcctagatgggtccgcacaacccggtaaacatagaagtttggtcctggcctgttttttgaattcttagtaaaaaattacacatgcaagcatccccgccccagtgagaatgccctccagatcacctggatcaaagggagcaggtatcaagcacgcataaacgcagctcaaaacactttgctcaaccacacccccatgggaaaaagcagtgataaattttaagtaataagtgaaagtatgactaaactatactaatatttatggttggtaaattttgtgccagccacagcggccatacgataaacccaagctaataaaactcggcataaagagtgtttaaggtctacattcagtaaagctaagctccatctaagtggtaaaaaactccagctgaaataaaacgattacgctccttgaggataagatgcatattgtaacaattttctatatcctccacaatgttttgcagattcaataactatttaatgaattgagttaaatttgcctatactcttacgctcataaataaccttctaattctcaattcctctaaaacatagaaaaaattgccaatataaaaaagcaagaaagaagatattaaccattttgtcattcaaaatatgactcattcttatacaactacctttgtcagcattcttgccattggactatctagactttgacgctggtatatcatggcttgttgttagagaaggtaaagtttggaaaacagaagcagttatgtaaagcaatcttagaaaatccttgagtttcccttagaattttgtgtcttctacatgttttctgtttcacatagattaagtttgcagagttatgtcataatttcatgagcgtatctgtcagagagccctttgaaggcctatttaatccaactaagaccattttttattgttttaataccattgaacttgttctgataattgaggaaaaagagaaagacattccatataatacaccagatgcctaagtgctttggatagtcataagccttttctcctatagcttcctatttagaaatgcctgctcttcagagttttcttaagctttccaacttgctccttccattttataagaataatagtctatttaggaagactattatcaaataaaaatcagaatgatcagtggacacctattttagccttgggatttatatcacaattccctaagactttatatttccagaaaagaaattcaaactaaaggtcacaattactattattatagtaatactgataagatgtgcattttaactaaaagaagttcccactatttttttttctttctacttttcaataatccttgggaccttagtaggagtgtgcagtagtcttgtggtgtatttttagtttaaaagtctgagcatacctaattaccacttggtagatattgttcaaactcacttttgaatccaagtgtttttaccctcatagaattttttttaaaacgagtatttgcttgtttctattatactgtaactattggagctactaggaggccttttaaatttcaccaacaagtaggcagaatggagactaactgaagggttgatgggcttaaagaaaataaataacctaacaaaaccaccaggctaatggcaaaaccaacattaggaaccaagtcactttacttgggattagtggataccaaaatgtgctttctcggaagcagcactttacaaggaaatatggaaatccacctttgttgtccttcagctaaagggaataaaatcatgtactttctataattttaaccctgttataacagatgctacatgaactcaagtggaactctgactgccttgagagctgaataaaatgcatcccaccatccgttgcagccgcatcaaggtattaaaaagagagacagaaggaagaggtgagagaggcacaagttcaacagtgtgaggcagtcagacacaatgggagggagaaagaaataaatgtctgaatgtcattgaaagaagagacaatgaaggcatatgtaagagtcctgctaaagctatggaacctcaggagcctatttgtaagaactacaatttagaatagggaacttgcaatacaatgcctgacctttatttcctttcctgcctcgaacttgtgaaaacctttgattgacttttctatgaacatgaattactgttacaatatttagttgaacaatatgaatttctcaaagcagtaatacagcgctacagcatagcttaacattgtttaagtaatatggtttgcttatatttaagtcatttctaagggacccatgcaaacacagtcaggagatctatttctgatgtatttccaaggctagaaacaaaaaaatgctgttaatgcataaacagtcaaaaaaccatgcactgtggttttacagggacctctatttctaaagatgattgttgcatgagggtctctgcctttatgaagggaaatgtgtagattttaactagctctgtttgtgttttgaaaaagaaaatcatgtttctgcactaaaaaataaattcctaatcaaacctttaaagttaacatttagaacagggacagaaacttctgttgtttcctaagtgttttgctgttgttcctgtttagttttaaatcattttttagaagttttattgaggtataaaaaaattgtacacctttcatatattcacctggatgaatttggacatgtgtgcatacaccaatatcatcatcacaaccaaggtactgaacatacttattcacctccaaaaattttcttgtgttcttttttaatggtggtagtatatttttaagaattcagcctttgagcagggtacgaaggaccttcaacaacaaatgcaaaagtaaatgagctaagttcatataaagggttagctctcagtgagttattcaagttatgatcatatcctcaagaggcttgtaaactgactgtgggtttccagtttggttattcacagataggccttcatttgctcattcacctattcattcatatagccactcattcattctcaagaagaggtatttgtccatatctcaccatgtggatgagcagatggtcagttctcacttcttttgccattaagtgtgctcaccgttgagctccaggatggtattttctctcactttgcgtcattaccaaagtggctatcaagattccctcccctaccttctttttcttttttcaatgtttaagagctggagttaatttcttgactcctttggtaacacatgccgatatataccactcaaggcctgttggattaaactgttaaatttgtcatctagctaatgttttctcagaaccagacaaattaaacagagtcaattgttgaaattatttcaaaagataaacaatcatagaatggaaataaactacagaaagtagggaacaggagtaactaagtctcctagaaaacatttgcagcagatgttaagtatccagtctcgttgttataaatgaatttcaaagaatctcatgaggagcagctttacaaaattttactgcactaacaaatggcagccaacctctgtagtaaacacaaaatactgtaccatcctttgtatctccttaaattaagccaatttctgcttacacagaaaatctgtctgtggaaaacactgcttagaatttgaaagcacattaatctggaagccacaacagaagtgtgcttcagaaaacttcttaatatttttcttgtgagttattctctttacgcttttcacattacaatattaccaagttatcataatgtattttctgcactcccagagcaagataagactctagtagttgctgggaactatgcattgtctaaatatgggttcacattctctcacagtgattctggaatcatacacacaaatgagatcactgctgtcagatcactgggattaagactcaacctctctactcactggccatgtaaatatagatacagtactcagatcctctgaggcttagctaattatcagttgatttggtctacacttaccacattaattatttgaaaggattcgttgatataacatgtgctgacaaccataatcattattaaggcaatgtttaccaatatgtgactttaaaacagatactactattagataacaattcatactatacattcaatatttaaacaacagaattataattttgtgaagcaaattttgtactcaaacagaaaatccaattctataattattttctgcaatattgggtcatagaaccaacaaagaatatatgactggcttagacgtatgtaattacttatgcaattagtaataaaattcttcactcattcctagatttgaatccctgatgctctgcgtagcagctgtatagtcttggacaagttgcttaatctgtctgtacctcgatttcctcatttgtacttcaattttcttatgtggtaaatataaaattacttaactcagagctatgaggtcagttttatttgagagaatccagaataaaatacttagcacacatttcctaccattcagcatgcataatacgtactcaaggaaattttagatctctgtacatgattaatatattaaatcctcaaaccgactataatgtctgaaaatgcatgtctttatgtcactgtacctctcactgcacttggcacagtgttgtgaatatatttgtcatttgtatgttctttctaccatacaattctgccactccaattagcatattgtgttggaaaacaattgggtgcttgccttatgttttactaaatttatacggaactacgttgacacttccttgcccttcagatgctggcactcactggttgctttctagttctcaggagtctctgtgtgactctgtcctttacacttgccctgcaacatcaccctcagccctagacaaagccaacatcatttttaaaaacctgcaaatatgtctgcaattcactgtatgaatattctcattctatcaaaaccctgacctcactaactcaatggagcaatacaggatgagaaagtagtttatatgaaagtcatagaaagcttgctttgtttattcatccaaacgtatgtttttaaaggacgaggcttttatctgaaacaaataaaattataatttgaaatttcaaataatgtgactaatagattatgaattcatttccaaatatagaaataattaaaacacttggggtatagaaaaagtgagtgctgtatctattcttttcttatattaattttaccccagctgccagaatttagttttttgtttttgttttttttctttttctttttttgagaccgagtctcgctctgtcgcccaggctggagtgcagtggcgctatctctccgctcactgcaagctccgcctcccgggttcacaccattctcctgcctcagcctcccgagcagctgggaccacaggcgcctgctaccacgcccggctaattattattattattatttttttttttttttgagacggagtctagctctttcgcccaggccggagtgcagtggcgccatctccgctcactgcaagcttcgcctcccgggttcacgccattctcctgcctcggcctccctagtagctgggactataggcgcccgccaccgcgcccggctacttttttgtgtgtgtttttagtagagacggggtttcaccgtgttcgccaggatggtctcgatctcctgacctcgtgatccgcccgcctcggcctcccaaagtgctgggattacaggcatgagccaccgcgcctagcgcaaagatgtattttactaataccacagaggtataatctgctgctacttcttgatcaggagtaaacaagtttacttcacagcagttgatctaattttcttccccattcattcaatggtattttttttattgttatagaacatactgaattggataataagtccttttctttttcttttttcagaaatggtttctactctgttgctgaggctggagtgcagtggcattatctcgactcactgcagcctctgcctcctgggctcaagaaatccttcgacctcagcctcccgagtagctgggactacaggtgagcaccaccatgtccacctatataatttttgtatttttttttttttttgtagagacagggtttcactgtgttgcctaggttggtctcaatctcctgggttcacaccatcctcctccctcatcatcccaaaattctgggattacaggtgtaagccactgcacccagctgagaaggctttttattataggttgttcttattgttttatttatttggtttacttgttggttttcaaggtaagtttgacatataaggtggtataatgtttaaaggtcaagttatagagatagctagattgaagttcaaatccagagccaagttacttagactctctaaggacttgttttttcccttataaaattaaaataaagtggatagccacttcataggtttgtaataagaattaatatgatcatgatgtcacagagttgcaaagagatactgaaacttggctctgccaaaaaatattagctattgccattatgattgttctccttaatacctaaggcatttgctgacagtcaggttactcatcatgtccttccaggaaaaaaactttaagaatgttgaaaacttaggaactacttttaaaatttaattttcagacctgacataacacagctgaggaagagaggtggtagctgattggggatagatgtagagatcattaatggtataagagtgtgagaatgtgaagcaggataggatatgatattactcatacagatcacaaatacatgtcaaaattatatttatcattcatttaagtaaaattcaacattgttttcttcaaagaagaaattgcgcatttcactctacctatttaactctggaaaattttacaaattgagcatgccattttttagtatgaattcctttatttcagctgccctgctaactttggcatgatgagcagaaaaaaaataaacagaatgattagttctgaaatatgaaaaagtgtccaagaaaaggagtagtcttgagaagtagggaacaggatgaagtcactaggggacagaagggtaggagggagtgggaccagacaaacactgagctctgcatgcacacgtaacagtctaaaatagtcatccagcacgcagactctaagtcaagataaccaagatgaattgccaacttctccacaagcaatatgactttgggtaaggtatttgagttttctgtgtcttagtttcttcaactgataaataaaaatgatggtcatatctacttcataaaattgtgataattgattaatacatgtaatgaataacgtttggcatttagcttaataataagacttttcattaaaatattagctacttttgttagctagcaactctcagttttgcctaaagctgaccccatatctagggtgaggttttgaaagaaattcaacaccatcagaagtaggtctggaagttataaaggaaagcttaaagaaacagaaatatgtgcaacacctatttacaaagaatccattgggaaaaccccattgagcccagggagatggcacatgtcccctttggttatggaattcagttccctgacggtcagtatactgtctttgttcccaaggcaaactttttaataattgtgatcccactcaatagtcatgttcacttactttatgggtacatttgtggcatattttaaaatgtgaagttgagtgcatttcacctgaaaaccaaaggcatgtaatgacaacatgctatagaggaaaaattattgatttgtgtaaataggcagatcttgtttgtattctagctccatcacttactaattttgtgatatgggcaatttatatcctatctgagcctgtgtttcctctacaatatgaggtaatttctactttgaagtattgttatgagggttaaatataaattactttctggtttatgatgttggtatatactacttctatgcacaaccgttatttttatgaataagattttaacagtaagccacagaaaatataatgtaagactgattcttagaatctatcaaaacaggttgtaaaaatgacttaaacatctagcatggcagtgactaacattttgaaaagcttaatttttccattaagaactatagcccaacacagtgtctgtgcttcagtgttcctcttatcaggaaggataatatgtgtgatgcatggactaactctaatgaaaatttttattcttaagacacaaaatatttcccagcacagtacataaggtctttgtgcttatgtcagcattggagataaatttctgggaaagaagtagagaaactgctcatttctatagacatcaaaacaccaaagtagccgggcgcggtcactcatgcctgtaatcccagcactttgggaggccgaggcgggcagatcacctgaggtcaggagttcaagaccagcctcaacatggagaaaccccgtctctactaaaagcacaaaaaattagccgggcatggtggtgcatgcctgtaatcccagctactcgggaggctgaggcagaagaattgcttgaacctgggaggtggaggttgcagtgagccgagatcgtgccattgcactccagcctgggcaacaagagcaaaactctgtctcaaaaaacaaaacaaaaaaaacaaccaaagtaaaagtgaaaataaaggtacacagcagactttttctttttaaatacctaaactgaaaagtatacctgtcaagaaacatccaactcatgaattactttaaatatgtttttaaaacagcgtgcttgttttataacaatagattcatgctagttatctgatattccccagtggttgctttgtggagctcagtgtcatccttggagaacatgggcaataaaaagcatttcttctgcaccagtaagacaaaaacaaactgactacttctcacataaaccttggagggcttccctcagtggggttagtgatcagcaaatcatgtcaaataaccccttttgttatttttgacataatagtgttcctagcagacagtactcaagaattcccagattcttagctgtaacataaatttaatatactctcttttattaaaagtcaagctgtttattcacagtagctcttaggtctacgtttcattttacacatatatgtggatgtaatagctttttccttagaacttttaaaaaatagaattcagtaaaagtcctatatttgtattttctatgtgtcaagaacagataagcatcattaatgtgaaccaaatttcaattgaggagctgaaattaggaagaattgaaaaacacctgaaataaatcttcaagtaataaaggggaaagtttactttagaattagtgtatcaaaaatgagaaaattggctgggcgcagtggctcacgcctgtaatcccagcactttgggaggctgaggcatgcagatcacctgaggtcaggagttcaagacctgcctggccaacatggtgaaaccctgtctccactaaaaatacaaaaattagccgggcatggttgtacatgcctgtggtcccagctactcgggaggctgaggcaggagaaccgcttgaaccccggaggcagaggttgcagtgagccgagatcacaccactgcactcgaaactcggtgacagagcgagactccataaaaatcaatcaataaatcaatcaatcaatcaataaaactttttaaaaagtcattgcattatttttaaaaaattaatagtttcaaaatgtatacatgtaaaatctaactgggaatactttgtatctacttgtagcacaagattaaatttattttcaattactaggagatttgcacaatagagtatatatttactttaatctgtatgactaaaagcctcattgtcaatgtgactatgtcatcattatcacattcatgaatctcctgattataacctgcacagatggtctacctacagggctctgggataagaaacttgctgtctgtctacagaggaagccgttttcacttccagatagttctgaatatttgcaagtacttgctgatttagagtcaaattatgtcttgctgtaacatccatgttactgaacttacatttgagataaaccaagattagactaaaccatgccttcaaatgacactctcaaaaatgtgatgcaatttatgtgccaaaactatcctatcttgccattttcctccattttttaggaaaagcatggtcctagttttgttagccacagttgacactactattttaaatcactatgtcatttgtatatcctacatttgaacactctttagtgtcttcaagttaaaatatgcataaaaactgcacgtccaggatactctacctggagaaaaacatagctctcattaaccttgtccagacattaaacttataagagaaaaatcattattttcctgtaaccaaattactctgctaaattgtttttaggcaggattaataaatctttactgtaaagggaaagaggctaagattttaggttttgtgggccatataatctctatacaactgttcaactctgctgttgcagtgagaaagcatttatagacaatatgcaaatgaatgagtgtgtccatgctgcaataaaatttaatttattgcagtctattggctggatatggcctgcaggccataatttgccaacccttggttgacagtatagctagctaaacactgcttgttgtagtaaaatcttgctttttaaaacatatgtctctcatcctagtattgtcattacgtgtgtgtggtttattgttaaatatgtaatatttaagggtctttcctatttagttttattaactaaaagctgtttcataattgtaatgcacagacatctatataggtttttattttatcattcaacctattagctaatccttagagttgtttcatttttcatgtgtttgacagatgaacatgtctaaaacactgatgataatgttaccagaatataaacaaaaatgaaattttcaggttaaaaccattttgttagtaatatgtaagtatatcaattaaccattaaataatttaccaaattattccattacctaatccatattgctccttcttgtccacaagaatatagtaaggtacattgtcaaatacatacctctgactttagtgggcatttaatgtattattagaggatcctgatatctgtctttcttaaagaaattaaactcatccctagtgattatactttcttcatctaacactataatattaataacatttgaaaaaataatgtctaataattaacactagatttacagagtatttttagacaattttctaaaattatctgaaaaatttgaccagaatcattgtaaaattcacatctgagcttatgaaagcccactttattccactctaaaagaacaaaattttgtacttttaattttatcttttaaaatgttttaacataaaggtagtgggagacgttactaaaggaagcttagatagtaacgtatttgttgtctcagttaacacaaagaccatagatggggcagatctgcaggatgcaaaaactttcctttttctcacctcatagtagtcatatggctactgcaattctctggtttcatgtgcttacaaaatgtcctttagttaaaaataaaaagaaagagaaagagaaagagaaagaaagaaaaagaaagagaaagaagaagaaaagagaaaaaataatttcttcatgtgtctatttaaattaacaaagacgtgaattgtcccagacctccctgtgatgagtaacttcatgtgtcagttttactgggctaagggttacccacatggctgataaaacattatttctgagtatgtctgtgtttccagagaaattagcatttgaataggtaggctgagtgaagaggatcatcctcaccaatatctatgggcatccttcaatctcttcagagcccaaataaaacaaaaaggcagaggaagggtgaatttaatctgtcttcttgagctgggacatccatcttctcttatcctctgatattggaacacctggttctcagacttttgggcttaggttgaactatatcactaactttcctgggcctccatcatgcaggcaggagattgtggaatttctcagtctcgacatccttgtgagccaattcctcccaagaattatcttcttctagctatctctgtctctttctctatctatttcatctgtatcagtatctgtatctctgtgtcgtctatatctgtatcatctgtatctttatctcatctgtctctatctctatctctacctctatgtctacatctgtcttagttatctatctcatttatggttctgtttctctggagaaccttaactaatatagtccttatcttacaactcacttgccagcttaccatgattataaccaagttgatcacttcaaaagaatactaaataatatatattgtttacactaagagatagctagctactctcctcaagctgaatctggcccccacctcacttagtagagcaagcaaactaaatgtagattatacattttttactcattgaaaaaacccaaataataacttatgacatgctaaaatttaaattttgatatacaaataaaattttattagaacacaattatatttattcatttacatttacattatttgtctatggctacttttacactaatgcagcagagtttgttagttgagacagaaacaggccaataaagaccaacatttttacaatataaccctttaaaaaaaaaatggacccttggtttagactgatcaataatcctatgggaggattttaatgattttcatctgtagccaaccaagcacattttttttcttggctaggataaatttagaacatctatgtccttccttaaaatagccccacatacttgaaagtctgattctctcataactatatttttttctctgctgttaaaatttgaactcattctcttcagaaataaagaaagtaacaaaatagaaactaagcagtcccatttttattttgccatttatgagggcctatgccatctagcggtgatttagtatgtatttaacaaccagttcactgagaaaaactgctgtatttttagtttgcttaatttagtggtgttgaatatttcctctatgaccaattttggcttacgaatatgatttctttgaatgcaaagttgggaggagatgagcactgtgtgctcctatgaggagttccatctggctcaaacataaacactattaacatcactttgctcaagacatgtgattctctttcataatgcttcttgcattaactgcaatataaaagttacaatccttattatttttgaaaaactcaatttgtataggactcttgataatattttaatatgtatacattttataattttattgatattttttcttcttttatacttttttttgtttatttatatagtttgttttcacattaaatgggagaaatactgacattgttcaattcacacccagggaaattctgtgtgaatgatatcatattatatttcttttaatgctctaaacaatgttgtgaggtaagtgttatctctgatttgcatatgaagaaacatattccgagattaaaaaattgcccagtttcacacaaggaataaattggagcacaggagttctatatagatagacctgtatgacttcacagagtgaaatggacagataaacaattcactttccaggagaaatcacaggacaatggatatcagaagaaatgatgggaccagggtaatattggatgttttgtatataaaaaactaatgtgggcaacaaaaaagcatataaagtcactgaagcaaaatatatattgtgaaatctaaaagaaaatatgctattggtaggccatggctacattataaaaaacatttcatttcacataaagtatgaatactacactatgactatgagttaatattaaaaaattgaccacataggaaataggagaaaaaagtaacaacactgtggaaagcaaagaaaatgactgcaagatgaagctatcaccaccatctcgtggccacatacggacctcctcagaagcttagatgaataaagggaagagactggagttattaaaatttgtaaactcagagtaaaagccttcctgagctgaggctagacctctgagggagagaaatgttccaactgctgctgttacctctgaagaggcactttctggggctctgaaaaaattggtaaactgaaacaattactgctcctagggcaaggggatgttcttgggagaatatcagcaaggacagcaaacaaacaggaaaaggagatctattcttccattctcttgcctatgtttctctagtacctcccaatagcagtacgtagcaggatcccacttgaaggaacttggaaaacgtagcttgctgatccccatcacggcatcatagcaaatttatttcagagaaatgtggctaaagatcaagattattagtaaatcaatttttttacctaatttttaatctgtattgatttcttataacataaatatctgtggttacagagacctcagtattttctttttcttctgtagcagcatttcaatcttttttgaagttctacctctctttcactgctagttcacaccatgtgagagcaatggacctaatcatcatgggcagtggtcataatatgtctcaacctgcccaaaataaagatgctaccccattaaccatatgttttattttgtaatacgatcatgatccaacctagtctaatgagaaacttaactagaaattttgttggaattattgaggaaaacagtgttcattttctgaaaaagtagcttagctagtaagatataagctcagtgctactagtggccatcttgatgtggaacaatactgagaatatttcttcaggtaatcctacaagaaatgtgtgcaaaacagaaaagaggaagttacaatgagaaatttcttacgtactatattcagtagagcctcagggtagctctaaatctagatacttaataagaatactactgataataaataatactcatatagcaaatactatgtgctaagcattctttcatgtactttataagattaatatatctaatacaaggactgtatgagatagatattattgtccagttttattatgtcctgcaaataaaatgccctgacaaattatattctctcaatcatctttcctttgtttgcaatcaacattttatatgtattcacttattatgtatcactcctttgattcctcaaaatttatttagggctatataaatattttgctactactggaattagcaaaactttaaggttaaattttcaaacatgttattgccctcatcatactgtagcaagaattagtaatcaatgatacataaaccctatttatttatccaaattattccatttcacatcctcacaaaggacactattctgtcaccatttaaccctgttccccaaaatctcctcataaatgcagtttcaaaaacagcaaatagataaattggactttattaaaattaaatttttttttttggtgaaatggagtcttgctctgttgcccaggctggagtcagtggtgccatcttggttcactgcaacctctgcctcctgggttcaagcaattctcctgtctcagtctcccaagtagctgggactacaggcacgcaccaccacgcccggctaatttttgtattattagaagagatggggtttcaccatattggccaggctggtctcgaactcctgaccttgtgatctgcccaccgtggcctcccaacgtgctgggattacaggcatcagccactgcgcctggcccttaaaattaaaaaattttttttaaagtttttatttttttgagacagggtctcatcatgttgcccaggctggagtacagtggcgccatcatggctcactgcagtttcaacctctctagactcaagcggtcctcccacctcagccttctgagtagctgggactgtaggcatgtgccaccacatcccagtaagttttgtattttttgtattatagaaatgggggccaggcacagtgctcactcctgtaataccaacactttgggaggccaaagtagatggatcacttgaggtcaggagttcgagaccagtctggccaacatggtgaaatcccctctctactacaaatacaaaaattagctgggcatggtggcacgcgcctgtaatcccaactacttgagaggctgaggcacgagaatctcttgagtctgggaggtggaggttgtagtgagctgagaccatgccactgcaccccagcctggttgacagggcaagtctgtctcaaaaaaaaaaaaaagaaagaagtggggtttcaccatgttgcctagactggtcttgaattcctgggctcaagcaacctgcctgccttggcctcccaaagtgctgggattacaggtgtgagccactgcacctggccaaaattaaaaacttctatgtttcaaaggacatcattaagaaagtgaaaagacaacctacagaatgggattaaatatttgcaaattgtgtatctgttaagggtctagtatttagaatatgtgaagaactatcacagctccataagaaaaaaacaaataatccaattgaaacaatgggcaggccaggtgtggtggctcacgcctgtaatcccagcactttgggaggccaaggtgggcggatcacgaggtcaggagatcgagaccatcctggctaacatggtgaaaccccgtctctactaaaaatagaaaaaaattagctgggtgtagtggcgggtgcctgtagtcccagctactcgggaggctgaggcaggagaatggtttaaacccaggaggctgcagttgcagtgagtggagatcgcaccactgcactccagcctgggcgacagagcgagactccgtctcaaaaaaaaaaaaaagggcaaagaatttgaagagatatttctccaaagaaaatgtgcaaatggccaaataaacacatgaaatacacacatgaaaaggtgttgaaatcattattcattagggaaatgcaaataaaaatcacagtgaggccaggtgtggtggctcattgcctataatcccagcactttgagagactgagtcaggaagatcacttgagcccagaagttagagaccagcctgggcaacatagggagataggcgtggtttgagcctgtagttccagctagtcgagaagctgaggtgggaggatctgcttgagcctgtgccgtcgaggctgcagtgagcagtgatggcgccactgcactccagcctgggcggcagagcaagaccctgtctctaaaataataatgataataataataataatagagataccaattcacacccactagaatgactataataacttaaaaaaaatctcaaaaaaaaaaaacccaaaaaacaaaaccccaacaactgttggtgaggatgtggagaaatgggaacccttatagggttccttacttatagggatgtaaaatgatacagatgctatgggaaacagtctggcagttcctcaaaaagttaaacatacagttgccatatgacacagcagttccattcctaggtcatcccaagagaaatgacaacatatgtccatacaaatacttgtacatgagtgttaatagcaacaatattcataattgtaaaagagtgggaacaacctaaatgtagatcagctgatgaatggataaacaatacgtggtccagctgggtgtggtggcacacacctgaaatcccagcgctttggaaggccgaggcaggtggatcacctgaggttggaagtttaagaccagcctgaccaacatggagaaaccccatctctactaaaaatacaaaattagccgaacatggtggctcatgcctgtaattccagctacttgggaggctgaggcaagagaatcgcttgaacctgggaggtagaggttgcagtgagccgagatcatgccattgcactccagcctggtcaataagagcgaaactttgtctcaaaaaacaaaacaaaacaaaaacaaaaaccagtatgtggtccatccatacaatggagtattattcagccacaagaaggagtgaagtacagattcatgctgcaacatggataaaccttaaaaacattatgctgagtgaaagaagccacgaaagatcacatatggtatgatcccacttatatgaaatgtttagaacaggaaatccatagagatagaaaagagatcaatggtttctaggagatggggagggaggcaattgggaatgactgttaataggtatgggattctttttaggtgatagaaatgttctggaattagtgtagatggttgcaaaatgtgaatacgctaaaactactgaattgtatactttgaaatggtaaattgtatgctatgtgaattttatctcaattaaaaaaaagtataggccgagtgcagtggctgaagcctgtaatcccaggctttgggaggccgaggcgagtggatcacttgaggccaggagttcgtgaacagcctggccaacatggtgaaaacccatctctattaaaaaaacaaaaattggctgggcgtgttggtacatgcctgtcatcccagctactggggaggctgaggcacgagaattatttgaatccaggaggtagaggttgcagtgagccaagatcacaccactgccctctagcctggtcaacagaacgagactgtcttgaaaaaaaaaagataaattatggtatttgctttggaattaaataattagtaacctttagtaaggtttggtaaaggtttagtaacctttagttaacccagttaacttctgtgtcttatgtttgtctttgtactgaagtagttgaatgccactgacccacagaatgagttgccagagaattggagcaacattctgttgtgggaaagagaatactctgttctaccttaaaattagattcccagcatatcaattgaagggttttaaatagtgagtgatgtgtttcaatttatatttatattatatttacacttgatcttagccaaaagtctgagaagtgattttatattatatttataaagatcactttagctttctcctggagactggattggtagggacaaggtgacattggtgaacttggttagaaagtcagtcaagcccatgtgcagtggctcacgcctataatcccagcactttgggaggccaaggcaggtagatcatctgaggttaggagttcgagaccagcctggccgacatggtgaaaccccttatctactaaaaatacaaagattaggcaggcatggtggtgggtgcctgtaatcccagctactcaggagattgaggcaggagaatcacttgaactcgggaggtagaggttgcagtgagccgagattgcgccactgcactccagcctgggcgacagagcaagactcagtctcaaaaaaacaaaaacaaacaaacaaaaaaccagtcagtactctagggaagaaataacaatagctatattatgacatagtagtgagttgaagataactgaatagccaaaatatattttggagatagtttgatgtgagaggcgaggaaaagtaagtagtcatgtgtggctctttgtttctggctttaataactccagtagttctggaagagacttagtgggaaaattaaggacattttggataaattgagtttgtccaaatggggttgccaagtggagagttgagtaaatgaagctagagctcaggaaagatgtggaccagagttataagtcatatttatttatttatttattttgagacagagtctcgctctgtcgcccaggctggagtgcagtggtgcgatcttggctcactgcaacctccgcctccggggtcaagtgattctcctacctcagcctccagagtagctggtattacaggcgtgggccaccatgcccagctaatttttgtatttttagtagagacgggggtttcaccatgctggccaggctggtctcgaactcccgactttaggtgatcctcctgcctcggcctcccaaagtgtttggattacaggtgtgagctactgcgcccagcataagtcatatttaaaacaatgggaatgggtaggaacacctagggatagagtgtgggaaatagagtagggtccagtatacagctgtgccaaatttcacatgtacaggttagatagtggagtgggtcagttctattgagaatgccctgaaagtttgaataatgataagcacgtccattttaacatcatgaggtagtggtgacgttgtaagaggagtttcagtgtagtgggttgtcatgggttaaaacgttcagattgtcatgggttaaaacgtgaattggatatgaggaagtggagtgtgcaaagatagttttctgaaagttttacttggaagaggacaaaaaattgagactagacagtttgaggaggatgaaaggtcaagaattctaagctagtgataaaaatttcgtcaacatcaatgaataggtaatgtaaacacattaatcctgggatggatgtgagaagagcaaagaaaggagtcatgggggaatatcagctctaaaggttgagtagagaaggaaggagtgatctgagaggtggaaggaggagtaggaattatcatagaaactttaagcttcttgagggcttgtgactgtgtcatgttcatcattttatctgaagttcttatcaacaaagtagctttcagtaaatatttattaaatgaagacaaaaattttaagagccatctgcaatgtcaaatgtagcccacagttgaatgaatatgaggaccgggaagtgtcccttgattttggagttaagcagctgattgccaccttctgtagaacagcttcagtggagtctccatgatagaaataaatgccaggttgctgaggactaagcgtggatatttgttgagagtggagacagtaagtgcaaacattcttttcagaaagctttgctctttttgaagctttgctcatagggagatacaagatagtaggtagaggggcaggctgtgtttagatgagagagacttcagcatgtttatatgctaaatggaaaaaggaaaaaggaagggagaagttgaagatgtagaataaaggaggtgtgtgtgaatgattgtacattgtctttgaggttagtgggaatggagtgaagatactgggttgcagtacagatgagaatacagtttccactgaagtaggaataaaggaacaatagatggtgcagatggggaagtgtttgggtggcaagtgagaattctggatatcaacactttatttttttcagtgaaggggggataaggtcatccactgagattatagtggggatgaaatgatgattgtaggggactgaggagaaaaggagaatttcaagaaagcctctgagggaagtgagagggcaagctgagtgggaatacttagaaaaaatggaatcatggatttttcacggctgtggtatatatatttgtatgaatgatttcctccttctctcagggctcagcagcctgggtgagcacacaattgaacagttggattggtcttggcctgggttttatgcgtcagtgtgacagagagggtaaggaggcaagatatttcagtagcgagagtgtttgaagtggtgggccattgagtctaggctgaatagggaacaaatgacaccagaaggtggctgctgggacatgaagtggttggtgttcaagactggatagtggaattgaagattgaatgggaggagcagttgctgggtatgacagaatacaggatccagctatggagtgggtttatgaagtagagacaacgttcccaagtctttagtgaacatcagagagtgtcatctgttagaactttagctgtggccaggcaaggtggctcatgcctgtaatcccagcactttgggaggccaaggtgggcagatcacctgaggtcgggagtttgagaccagcttgaccaacattgagaaactccatccctattaaaaatacaaaattagctgggcatggtggtgcatgcctgtaatcccagctactcgggaggctgaggcaggataatcgcttgaacctgggaggtggaagtttcggtgagccgagattgcaccattgcactccagcctgggcaacaagagtgaaactcagtctcaaacaaaaaagaacttttgctcaaaggcaggtggtagcagataagaggtaaggaaaatttagtgaagaaaaattcagtttttaaaaacgttttaggctgggtgtggtggctcacgcctataatcccagcactttgggaggccgaggtgggcagctggcttgagcccaggagtttgaaaccagcctgggcaacatggcaaaacctcgtttctacaaaaaatacaaaaaattagtcaggtatggtggcatgcacctgtagtcccagctacttgagaagctgaggtgggaggatctcttgagcccaggaagttgaggctgcagtgagctgtgattgtgccactgcgctccaacctgggcaacagagggaaaccctgtctcaaaaaacccaaaaaaacaaaaaacaacattttattttggtgatggaattctctattgtttcgaagagttttgtttgttttaaagacattaaccagttttctcgagggatattctatgaaaaagtgggttccatcatccaataagtttgagaaactgcaaactctatcccgttggtaattcacaatgaacctcaacttagattaataaaggctctgggaaatgatgttactattaatgatttaacatttattgagcactgtctaaggctctgttctaaggctcccacatgcattattgtttccagtctttacagcaactatctcaatttaagtcacacggctaagctggaatggaagagctgggattcaaatccagaaagacttgctccataggattctcaagcctataaccagtatggaaacaggcttgacattaaatccagcatttccccatcttgtttggttatggaaccttattatcttttagtatttatagagagattagtcagttgtccacggcatggaccctgggaagtgtcgcctgagtcagtttacactggtgactacagtcttttaaacagcattgtttcagactataactagttttttctaacttggttctctgttgataatacttaaatgttatatttatttttctatttgagagccttatattttgacttcaaggcattttctattccctttcacaatgaccttcccaggaatcaaagatattgtcaccaccacacattacatttgagttactaaaacagtttataatccaaatagctatttcactttcctttctctggtctaagattatcttattgtaatttgttttttaaatttagagacagggtcttgctatgttgtccaggccagtctcaaactcctgagtagctgaaaatataggcatgtgtcacctcaaccagtttattgtaaaattttaatgtttagagatcttggagatcatcttttatttttaacagtatttatttagttttgcaggtagagaaaatgacagctgtgtagtgctgtggaaattataataattcatatccaagcttgaatgtcagctctacctctttactatagctgtggccttacaaaacctacttcgtttcttgaaacttgtttcttcctctaaaaagatgaggataatatcttgcagggtggctatgaaaattaagacagttcacacagtatctggcacatggaaagttctcaatgttaattacccatttttttctgtttaaggaaatagtctcaatcctataccatgaatgaattatgaaaatagttggaaaggaaacaacagttttaaatgtaaactgtctcagtcttatgctgacatcagctacatttctggtaaagtgatggtgtcatgatacaggttatattaagagttaaaaccagtttccttctggctttccaactgacataataagcaaaacctgcctgggcaaacatagacctatttattggctcacttattattaatgttaaagtagctttggtgctgacttctcctgttcttgttttaaaatttcactgttgtcatttgaaatctgacagaccttcagaagcttcatagaatgcttaatggtttaaatcgtctctagaacatgtgaagtatcttttccaaagtggttttctccatctgtcagtatgttcaaaatcatgtgtatagggccgggcgccggtggctcacgcctgtaatcccagcactttggaggctgaggcgggtggatcacgagatcaagagatcaagagatcaagaccatcctggctaacatggagaaaccccgtctctactaaaaatataaaaatcagctagccatggtggcacgcacctgtagtcccaactactcgggtagtcccaactacttgggaggctgaggcaggagaatcacttgaaccagggagacggaggttgcagtgagccaagatcgcaccactgcactccagcctgggcaacagtgcaagactctgtctcaaaaaaaaaaaaaaaaaatcatgtatataggacagaattgcttatattttcacatttactactggatgcctgtttggttttcatagcaatcaacttttggagtttatgggcagtacttaacatatataacctaagtgtggataattatttaaaataaggctattggaagaaaaatctatagggatttctcagttttcacaacaactccctgagcaaagaaaaaataggttggtttgagttgtatgtgatgagatttctaatattctatttgaaatgccccctagtaagcactagtgataggtattaatgagctgaatttgatttccagttccaactctgtcccttgcaacttctgtaaccttgaaggtttctctacgtttcagtttcttcatatgtaaaagagattaccaatatttccctcccaaggctgctgtaacagtgaagtgttgaggtttttatttatttattatttatttatttatttatttatttatttatttatttttttgagacagagtcttgctctgtcgcccaggctggagtgcagtggcatgatctcggctcactgcaagctccgcctcccaggttcatgccattctcctgcctcagcctcccgagtagctgggaatacaggcgcccgccaccacgcccggctgattttttctatttttagtagagatggggtttcaccgtgtcagctaggatggtctcgatctcctgacctcgtgatctgcctgcctaggcctcccaaagtgctgggattacaggtgtgaaccactgcacccggctgtgttgaagtttttaatatagccagcacagcatgtggcacatagtaggcacacagccattgcatgtttcttccagacatctcactgcatttttcagtaatattcttttcaagtacgttcttctttctcattccttaacatttaaaagctatattcaagagagaatattaatgtttgccaagtaaactgaaaatatttcctttgcagcccacacttaagagtgttttaggccgggcgcggtggctcatgtctgtaatcccagcgctttgggaggccgaggtgggcggatcacctgaggtcaggagttcgagaccagcctcaatatggagaaaccctgtctctactaaaaatacaaaattagccgggtgtggtggtgcatacctgtaatcccagctacttgggaggctgaggcaggagaattgcttgaacccgggaggcagaggttgcagtgagctgagatcacgccattgcactccagcctgggcaacaagagcgaaactctgtctcaaaaaaaaaaaagagtgttttagcaaaaaatgattttatgtatgacataccttggtttaaatcctggctttttaattgtaatttttttattttttgagacagggtcttactctgtggccaaggctggggtgcagtgatgtgatctctgctcactgcaacctccgcctcccaggctcaggtgattctcccacctgagccacctgagtagctgggagtaaaggtgtgctccactatgcctagctaatttttctatttttagtagagacagagtttcaccatgttgcccaggctggtctcaaactcctgggcttaagctatccaccagcctcggcctcacagtgttgggattacagttgagagccaccaagcccggcctgaatcctggcttttgaatgtaatagtgttgtgaccttaggcaagctacttaacctatccctaaagtattatgaggctaaagtgagtaatagtatgtataaaacatctagttcattgtctggtttgtatattcccaaaataaatgttattattttaagtggaaactgttgtttaatttgataattcatataattcatggcttttgagagcctgctctactcaaagcccgttaagagcaggcaggaacattgtgaacgaatgttgggcatattattatgcaagtgactgaatttggccttgcctgtaatcaggttcagcaaaagtggtattttctttctttctttctttttttttttttttaaattgagacagtctcgtcctgatggccagactggagtgcagtggtgtgatcttggctcactgcatcctccgcctcctaggttcaagcgattcttccacctcagcctcccaaggagctgggatcacaggtatatgtcaccatgcctggctaatttttgtattttttgtagagatgggggttttgccatgttggccaggctggtcttgaactcctgacctccagtgatccacctgcctcggtctcccaaagttctgggattacaggcgtgagccactgaacctggccaaaagtggtattttctattgcatttgaggtaacagaaattgatgggcttgttattgcatttggcatggctttttttttttccatgttgtctttctccactgactgtcaaaaaaaaaaaaaaaaaaaaaggctacattcatgagtgccacaagagagatccatgattcccaagtgctacagcagaccaaggtatattttggtatctaaaatgtttttcatcttttgctgatcttgtttattagaaataaatatgttactctcctgtattaaaatttaacacaatattggcaagctaaatttaatcaaatattctgcccattttaaaattcacttcctagcctgtccatccttccttttattttgttgtttgattttgttttattgtatgcttttagcagcctgaagccatggtttttagtttctgtctgtagtgataagtggaaaggagggatgaggaaggggctttactggcccaaccagaaatagaaactaagaacccaggactgtattatctcccttggacacccaacactatataaaattgattcctgccctggcagactaagcattggaaagctggtgctaagagtgttatgagaattcctaacaaatagaaaagctcaaggattgacactatagtaaaagatttcattttgacatgtttataatttacttatcaagttaacaataaggtgtttttatttatttatttttgtttatttttattttatgttttgagacggagtctcgctctgttgcccaggctggagtgcagtggcttgatcttggctcactgcaagctctgcctcccgggttcacgccattctcctgcctcagcctcccgagtagctgggactacaggcacctgccaccacgcttggctaattttttgtatttttagtaaagacggggtttcaccatgttagccaggatggtctcaaactcctgaacttgtgatccacccgccttggcctcccaaagtgctgggattacaggcgtgagccactgcacctggcctttttttggtatttttagtagagacggagtttcaccatgttggctaggctggtctcgaattcctgacctcaaggcctgccttggcctcccaaaatgctgagattacaggcatgagtcccagtaagatttttaaagggataccaaaataatcaacatttattttagaaggtgactttcttcaatgagatgtcaatgtctactttctgttatatagtgctattgtttcttttttcttttttttctaagtgagggtctcactctatcacccaggctggagtacagtggcatgatctcgggtcactgcaaccttcacctcccaggttcaagcaattctttcacctcagcctccagggtagctggaactacaggtgtgcatgcctcgctaagttttgcatttttagcagttgttggccaggctggtgtactgtttcttttattgactgagatctatatttacacagcatgaaagtctcagttgcattaagtacattcgcattgttatgcaaccatcaccattatctagttccagaattttgccgtcaccctaatagagcttgtatatatgtccccaccaaatcttatgttgaattgtaattcccagtgtttgaggtggggtctggtgagaggtgtttgcgtcatggggcagatccctcatggcatagtgttgtcctcgcagtagtgagttagttctcacgatctccttactccatccacctgcttctcctaaaactttgaaatacgcttggaattgaaagtgtttagtttagattgaggatagttatctaaaagtgacatacagggctcctgctttgctcttccttagtaaatttcctattttattacacagtttactaatacagaggacttgagttttgttatttccatggaaaacattattgaatctaaatttaactagagatgtgtagttcagggagggagagtggttttataatatgaatcttggatttgaaatgaacttaaagcaaatgaataaaaattgtttcattaattataatgtctgaaataatgcatgtttttgtgaataaaaattgatataataaagtttaaagtgacaggagtagatataactaattgtatttataatttcttggaagtaaaataacatttttgaaaaatattatacaatgacctcacatacagtgacctcacttaatctatgtgaggctatacacagtggctcatgcctgtaatcccagcactttgggaggctgaggcaggtgattgcttgagcccaggggcttaagaccagcctgggaaacatggtgagaccctgtctctacaaaaaatacaaaaatcagctgggcatggtgaggcgcacctttggtcccaactacttgggatgctgaggcaggaggatcacttgagcccaggaggttgaggcagcagtgagctgtgatcgcaccactgcactccagcctgggtaacagaatgagaccctatctcaaaaaaaagaaaaaagtctatgtggaagacaccacgttaattgtgttgggtggtttagagatgtttctgtctccttcactgatgaccgtgtgtctctgctgctgtcgctcactggtgattatcaactcaacctcttatatttgttttaacaaatatttatacaccctttgtaaatttgcatgagataaagtcattatagttaaaaaaaaattttttttttttgagacagaatcttgctccattgactaggctgagtgcaatgacatcatcatggctcacggcagcctgaacctcctgggctcaattgatcctcctgcctcagcctcctgagtagctgaaactacaggtgcatgccaccatgcccagcttgttttttattttttgtagagacagggtctcactatgttggcaggctggtctctaactcctgggttcaggtgatcctcctgcctcggcctcccaaagtgttaggatttcaggtgtgagccaccatgcctgtcctatgaagtcattacaaagaaataaaattaattggtttcattggcagtattgaatttcaaagcagaaggggtgcttaagagaaataatgcctttggagtaatttctgatgctagatgaaactcatatctcatttaaggtgtccatctgaattttatgtttggatgattgtgaattattccttaaagcttgaagtgaactctggctctctaggataaattaatctttattcctttaatctttattcccttagggatatattaaagggatcaaatttttttttagagtaatgtaaaattaagggacttcttttgttaggtgaatttctcaggttttaagatatcagtatcattgtggacattgactacattgtctactaaattctgtaattttaacttataattctcagtaattggctgggtgcggtggctgacgcctgtaatcctagcactctgggaggccaaggcggcagatcacctgaggtcaggagttggagaccagcctggccaacagggtgaaaccccgtctctactaaaaatacaaaaaaatgagctgggtgtggtggcgggtgcctgtcatcccagctactggggaggctgaggcaggagaattgcttgaacccaagaggtggaggttgcagtgagttgagaatgcgccattgcactccagcctgggtgacaagagtgaaactccatttcaaaaataaataaataaataataaaaataaaaatacaaaaattagctgggtgtggtggcgggtgcctgtaatcccaactactcgggaggctgaggcaggagagtcgcttgaactcgggaggcggaggttgcaatgagccgagatcacgccactgcactccagcctgggctacaagagtgagactctgtctcaaaataataataataataataattcttagtaatttttgcaatttttttggtacctaaaataatttctgttattgtgttggataactttgtcaacttcactttgggaatatctaaatacaggtagctgcattcgagccagaggaatattgggtttttttgttgttgcttatttttgaggcagccttactttgtcacccagactggagtacattggcacaatcatggctcactgcagccttgaccttctgggctcgtgtgatcctcccaacccagcctcccaagtagttgggactaaaggtgtgcaccaccatgcctggctaatttttaaatttttttgtagggatggaattttgctatgtcacctaggctggtttcaaactcctaggctcaagcagtcctcccaccttggcctcccaaagtgctgggattacaggtatgagccaccacacccagttgagaaatactgggttttaatcaagattattgtctgaatattgagtcttaatgacttttttgattttgtttttttggccatagtatgaagtttgctgttgataaccttctgtactaactagaagtagtatagaaactgcaaattaaaaaaaaaaaacccaggtaaaatgttgatggctgctatttttatttaaggtattaataaaggaaaagaagtcagggacattatggaggtcaagttttatattattaaaactcaacttcatgatttatacatacttagaaatagtctgagtgatgtgtgaccaaaatatgatttctaggaggaatgatagttacatccgtggaatagctgcgtacactttattgttcttggtgcttaaactttagttgtcctgctaagataaaggaagacattctttcagttggaaatcatgataatgtatttctccattgaaacagtatggtttgaacagtgctatatattcatactcattattattccttaaatgaatattttaagctcctgatagaaggcaggtactgtgttatatgctgtttgtgttaccagaatacgaagatgaagagaacaaagtattacacaattcctaatctcacataaatgctatttttttttactagctgtggggagcacaaaataagtggttgaaagtcatctgacacagttacatttattcctttccttttccatggctcttaggaataaattgttctactctatggattaaattgccctttgtttattgcctgggatcccaactttatttcctaattttatttctttgaggaaacgtttcacaagttttataacaaagtataactcaatttggagagcacaatctgtgcataagttggaggctacctattgtgaaatggaaaaatgcttgtcctagcattactgagttaatgtatagctggtagaaagttttcacttttaattgctaacttgcctagtgagagtgaaagattgattacggcaactaaaaagtataaaaactactgagtagtttttaggtacagtcagttcttcagtagaacaagaatcttttttttttttttttttgagacagagtctcgctctgtggcccaggctggagtgcagtggcgggatctcggctcactgcaagctccgcctcccgggttcacgccattctcctgcctcagcctcccaagtagctgggactacaggcgcccgccactacgaccggctaattttttgtatttttagtagagacggggtttcaccgttttagccgggatggtctcgatctcctgacctcgtgatccgcctgcctcggcctcccaaagtgctgggattatgggcgtgagccaccgtgcctggcttcactcagtgttttcagttaggaaacttacattgtttagttttgggacattttcttgaattatttcactggttttttttcctctctgttttctcccgtggattccccattgcatagatgctgaattatcttgactggacctccagttttttcttcttgattctgttgccatctctttgattccttattgtttctgataaattttcctaagtttaatttccgagagctctttggaaaagtatcgattttttttcatggatggagtatctactcttttgacacagggtcttgctctgtcgtggctcactacagctttgattgctcaggctcaagcgatcctcctgccctagccctcccagtagctggtactacaggcctgcaccgccaaacctagctaacttttttgatttttagtagacaaggtctcgctgtgttgcccagactggtctcgaactcttaagcgccaagcatttctcttgcctcagcctcctaaaattctgggattacagtgtagtatcttctgtatcctttccatggacgctaatgatggggtataaaattccttttatttatttattttttattgacatcagaaattcctgctaataaaattctttttaaattttaagtttttttcttcccacagttgtccgtgtttcctccaagttccttttctattttttgttttcctttgttttctttttgtggtagatgctttcctcagatgagtggtaatccttggctatttgcagttatgcctctaaaagctgattggaagctcttagtacctcattggtacttgttgactagagttcactctagggtgatctatctgtgtcatttgctggggcacccttcatgtcagcttctgattacttttcccttttctgaaaagggagagaggtcttttaatttcctgtctggtgggaggaggtctgtatgccacttctgtgggagagtgagggaagtagggcagtgaggatttcagtattcagtacatatgtgttttcttaaggcctctgttttcattaagcctcccccgcaccaatgtgctttatgtttccctgctctgaaatcctcctgagggaataatcctctagaattttgccttggtgggaaatgcatagtaacctaaccatgtggtatttaggaaggtactgagagattgagcgtttcctaaggagctttcagccagccttctttatttagtgctcccttcacacctgtttctacaggcgctatctgttaccagttcctgagccttttgaagattccgtggacgaaggttggtttttggctttccatactgctggtttcttggatctgctatgtcagttaccatttatgcatttgctttctagcttttaagttttgtttatgccttaaaaatacctgatgagggccaggcgtggtggctcaggcctgtaatcccagaactttgggaggtcgaggcaggtagactccttgcatctgggagtttgagagaagcctgggcaacatagcaaaacccgtctctactatagaaaaattaacccggtgtggtggtgcacgcctgtggtcccagctacttgggaggctgaggtgggaggatcgcatgagcctgggatgtggaggttgcagcgtgctgagatcatgtcactgtactccatcctgggtgacagaatgagaccctatctcaaaaacaaaaacaaaaaacccccaaaaaccttattagtattttagcacaatttggggaagaaatgaagttaaatatatgtatgttccatcttctctttacccagaacttatttctaatttttttttttgttaagcatcttttttgttgtggtaaaatatacataaaatttattatttataagtatacagttcagtgacattaagtacattcacaatgttttacagccatcactactttctagttctagaacttttctatcacaccaaaaagaaaccccatacccattaagcagtcactccccattccctccctccctcagcccctggaagccacaaatgtgctttttgtttctatggatttgccttttgtggatatttcatataaatgaagtcattcagtatgtggccttttgtcacatgttttcatttaccataatatttttgtggttcatctatggtatagcatagatcactgcttccttcttttttatggctgaataattttcattgtgtggatatatcacattttgtttatctgttcatcagttgatgaacttttgggttgtttctgctttttctggctattgtaaatagtgctgttatgaacactgatgtacaattttttggggtgaacatttgtttttattcttttaggtatatagctcggtgtggaattgctggatcatatatggtaattctgtctttaacttaatgaggaactgccaatctgttttcctcagtgactgtaccattttatattcctattagcaataaacaagtgtcccaatttctccacatttttgccaacactgttttccattaaaaactttttattatagtcattctagtgggtgtaaagtggtatctttttgttttgatttgcatttccccagtaactaatgacattgagccttttttcatgtgcttgttggccatttgtatatattctttggagaaatgtctgtttaagtcctttgcccactttaaattgtgttgtctttgtgttgtagagttgtaagagttctttatacattctgggtactagacatgattttcaaatttagatacatgattttcaaatcttttgcctctagatgttttttacttttttatttttgatccttgaactcatctatattctatggttgtgatgtaatgatgacagaattggtgtcatttgtgtttatttaccaggttatttggaaggattatattttaggtgctctcctctcccccagtaaatggtattacgacacaagggttataaaggactgataagaaattacttaagacagaaagggaagttggcctgcttccaaaatgtggtcccagcagaagtgaagttagttacaccaataactacagtcaaaaagctatttttaaccatgataatgtacttgttgttattaatattaaagattatatttttccaggtgcagtggctcacatctataatcccagcactttgggaggctcaggcggatggatcacttgagctcaggagtttgagaccagccagggcaacatggtgaaaccccatctctacaaaaaatgaaaaattaaccgggcttggtggtgcgtgcctgtagtcctagctacttgagagtctgaggtgggaggatagcttgagcccaggaggtcaaggctgtggtgagccaagatcgtagcactgcactccagcctgggcaacaggacaagaccctgtctcaaaaacaaaacaaaacaaaacaaaacaaaacaaaacaaaacaaaaccgactatatttctgcattaagtgggggtatggaatcctatctaatatttgagataataattgttatagtattttattgagcttttattgggtaccagatgtgttctaagtttttttcgtgaattattttcattaatcttattcattgttgtgtcctgaatgagtactcacatatttgttgaagggctcaatggtccctaaaaccttagatgctgttttggaaggttaacttgccaaaggtcacatagttggcaaatgatgaagctgagattaacattaagatctgattccaaagtagtctttcttaactgtattgctttatgtggagttttgccattgatgtctagacagaaaatctctagcaatggaaaaaaataatttttaattaattttaatttttttagtgttttgcttcttttttttttattttgtgagccaccgtgcccaattggtttcttttaaaagactagttagcttgtgctttaggcctcttgattaatctgaggtatttaattaatatctttgaaatcctaagatttactgtatcacttctgcaatatctaaatttttccttcttacttatttctgttctccttctacagtcctttctattatgtttaatcatcaaaacgttgttcttgttttctattgcaatctaatttttagtgttatgctgtttccagatgccatttgggtcattttcaaaaaaagatgagtaataattagcaagtaatgaatattgttctttttaccattcattaagaacaattgttaattgtcttattctattgtgaagaatatctgtaattcctgcttagaacctgggttgatagcaggatatcaggaagcactaagtgtacacagaacgatatagctggaaaaagtatatatgttaaagaataatatgttgtctaaggacagaatggaactgatcacacaggttcttttttggtaagcttcaaaacttcttatctcccatgaaagtactttttcttttataatatgcaacaataactttctgtttagttaattagttttaaaacaagcttaaacttataatttataaagaatcatatttgctccctatcattgttttatagctggggctatactgacaaataagaaaaataaaattcctgcccttgtggaggagacagttaaaaaatgagacaaatacatttcagatggaaatgaggacaatggaagaagagtagagcaggatgaaggcatgaagggtgactgagatctggtcaatctttagatagtgtaatacgggaaactgctttgaaaagatgacttttgagcagagatcttaacgtactgagggagtgaaccattcgaggtctggggaaagaattcagcttcctcttcagatgtacaaaattacaagatattgccattcttgtaactgaaaacctataaaagcaggataagaagtacggtttctaaaaacccatcgaagagctgaggatacaagggagcctaaatgaaccaactccagaaagtaatcaaactttcatagtggagaagaaacccatggttgctctaggatggaacaaccaaaggaataggaatccaccatagatgaggggaaaggagaaaccagccacatttttttaaaatcagatttttaatggccacgtatgggctggtttgacaggttaggatcctaagaagccctagcaactctggcaccaaagagcaagtatgcacccacactccagctcctacccacagatgttcactgaatgttcaggagtagtaagccaaaagcctgggccagtgatgaactggcatagataatacctgaggcatttggaacctctcccaagtatagggcaaccacccttagaaggcaggattgctgagaaaaatccagcagaggctctccaggctttcagttctggaatgctgcaggcaggggaagagctagagataactctcaccccacactctggcagtccatgttttcagccaccaaggactggggacagggcagaagaggtgagtgaaactgctctaattcatttcaggccttcacagaatgtaaggaagctgccctccagaaggctggctggggaggaggagcagggctgcacgagggcacctgagcttcagaaagcaaggtgtgcgactggagagcaaggagaatctagcaaaccaaactctgaccgtcgcgcttaatgcagagatagagttcctacagttttttttttctttcttttttaaaatataaacttgaatttttgaaacagtttcagatttaaagaaaaattgccaagatagtatggagagttcccataaatgctgcctctagtttttcctatttttatttaatttatttatttttttagtttttcctatttttaacaccttatattagtatggtatatttgttataattaatgaactaatactgatatattttcattaactaaagtccatactttatttacctaatgttttgggatcccatttagctgtcacgtctccttagggtcctcttggttttggcattttcttagacttgagcttctcatctcttgtttttgatgactgacagttttgaggagtattgttcaggtattttgtagaatgtccttctattgatatctgtttggtatttttgtcattgttacagtgaggttttgtatttttgggacgaagaacatgcaggtgaagtacaatttgctttcctttttttgagacagtgtctcactctgtcacccaggctggagtgcagtggtatgatgacagctcactgcagccttgaactcctgggctcacatgatcctccctccttagcttcctgagtagctgggactacagatgcatgccaccacacctggctaattttttttttttttttaatagagacagagtctcactgtattgcctaggctggtcttgaactcctaggctcatgcaatcctcccacttcagcctcccaagtagttgggactacagacatgtgccactatgcttggcagtaccattttcatcacatcatattaaggggacatactgtcaatatgactaatcagtgttgatattgaccttgatcatctggttgaggtagtgtttgtgtatttctttactacaaagttactcttttttctcctctgtttacatactgtactctttggaaggaagttacatatgcgcagcctacacttaaggcatggggagttatgatacccctcctcaagggcaaagtgtctatataaattatttagatttcttctgcatggaagatttgtctcttcttcctcatttatttatccattcaattttttaaatattagtatggacttatggatattttataccttgggttaaaatcttattattgctttatttattttattgttcaagttgttccagctttggccactgggagctctttcagttggtatgactttttgatataccactgtcagtgtatgtgtgtgtatgtctgtttgcactttctcactttctggcactacaagatgctctagtatatttagagactaaagcatgtagtatatgctttagtatatgctttatctagtatatttttctgtctcaatcctagaattagccatttctccatggagccttggttccttttactggagaatggagaaaccaagatctaggtgctaggtgtacatgttgctactggggtgtttttgcttgtaggccatctcagctgacagagccagaaaatgtatgtatttatactaccctgtatatatccacatatctataaatatttctatatgtatccatccgtatctaattaagctaaacatgagtttatattgatgtattaggttccagttgaatcactacatggatgattctaacttcctgcccttgcttatctgaaaactcctgctccaatagtgagaaatctgtctcctaccatcagccacccatttacttaatcattctactctagtatacatgtaaggtactcccacagttttaaaaactggtggcttggctatgaaacacaagcaggtctctgtaattttacctaggctcagatcccagacctgctcaagtgaaaggcttgatctcagtccttaaatatttgaagccagtgattaactgttaaattaaagctgcatcatagcccacacccagctcagttacatattggattgactcagactcccttctagtgtcctaacagaaaaattgtcatgtctttttctggaagtaaaatattacttaatttaataagtaatctatttttatataaaatgtctggtgtgtaatgaaaagttacaaggcacaagaaaagcaagaaaatgtgaccaaaggtcaagagaagaaatagtcagagatgatccagatttatcagaattatcagacagggatttaaagataattatgaaaaaaatgctagatgattgaatgataaaggttaacgatatgcttgaaaagatggggatttctgtagagtcatggaaattatgccaaagaaccaagttgaaattctattaaatagaggtgaaaaatatactagcagagaccagggaaaacaaaaaaaggaaagaaaagaaaaggaaagggaagggaggggagggaagggagaaagaaaaatacactagcagaaatgaattcattacatgggcttaacagtttatggacatagcagaagaaagaatcagtgaatatgaagacagattggaaagagaaaagacagaaaaagtcagggaggggtagaaaagagattttagatctgtgggataatatcagatggtctaacatatatgtaattggagtttcagaaggagagaagagaacgtggcagaagacatatttgaagaggcaatgctcaggaacttctaaaattgatgaggtcatcaattcacaaatggaggaagttcagcaaatcccaagcaagttaaatacaaaacaaaaataagccaacaaatttaaaaatcccatatataggcatatcataatcaaactgctgaaaactgaagatggaagagatcttaaaagcaacaggagagcaacaggagaataaaagacacattagttatgtgagaatggcaacatgggttatggctattccatgttttagggccagaaaaaaatggagtcttagctgagcatggtggcacatgcttgaacccaggagttcgagtccagcctgggtaaagtagtgagaccccatctctatttaaaaaagaaaagaagtccaggcacggtggctcacacctgtaatctcagaactttgggaggtgggcagatcacaaggtcaagaggtcgagaccatcctggccaacatggtgaaactgcgtctctactaaaaatacaaaaattagccgggtgtggtggtgcacacctgtagtcccagctactcgggaggctgaggcaggagaatcacttgaacccaggaggtggaggttgcagtgagccgagatcatgtgccactgcactccagcctgtcgacagagcgagactcagtctcaaaaacaaagaaagaaaagaaaagaaaaaatagaatgttaaatacaatgggatgacatccataaagagctgaaagaaaaaaaaaaaacaacctgttaacctagatttctatggccagcagaaatagccttcaaaaataatggcaaaataaagactttttggacatatcaaaaagggaaagaatttgtttccagcagacctggactcaaaaaacattaaaacatacacattaacaagatgtgggttttacagcatatatgtgattatacaaccatgaaagaacaaaaaggaggagatggaattatactgtcacacatttcttactctgtgaaaggagactgtagtaacttctggatgcatatgtaatctctagaacaagcactaaaaacacaaacagggataccataaagtcagtacatctgcccaagagggattaactgctacgagaatcattctcctactgtaaacagctagaaaacaggacaaaaatacatgaaacaactgttttcagacattggacaacaggcagcacaggatagtgatccctgagagaagggaaataactgatatgaaccctacaggggttcctataggcagtttccagattgtagcacagagtaggggaatccaaatagagcccaggagagtttggagaagtcaaggcaactagaatttgtggggcagaaaacaagaataaaaggaactacacagaaatctatagaagtaagagaatctttgattggacactcatctgcacatgtgaagtgtggaagtcagcaatgctggagaaagtcacactggaaatcagaacactgaacaattccaggagctcacacagagctgggaatagtttatgtttccattaggcatagtggagagactgtttcatacaaaggacattggctagagtcttcaaagtggggttaaattagctatagactaaaggcctttctaaacctaccctaagcttcaaggcaggttttgaaaggaccaggctgattctaagtaactcaattatgtgccaaaactaaactcttttaaagaatacagtaaatgccagcacctaacaattaaaatgttcagcattaataatatattaatgaaagattactaggcatacaaataaaaagcaggaaaatgacccataaccaggagaaaaatcaatagaaaagagacctagaaatgtggaattattagaaataattctgatgattgaattatcagccaaatatgttaatacaagtattataatgactagtagagaaatgaatgatagataaaaagacacaagccagatgtggtgaatcatgcctacagacttgagggtaggcagatcagcttgcccaacatggcaaaaccctgtctctactaaaaatacaaaaattagctgggtgtggtgggatgtgcctgtaattccagcttgggaggctgaggcacgagaattgcttgaacctgggaggcagaggttgcagtgagctgagaacatgccactgtactccaacctgggtgacggagtgagactttgtcgcaaaaaaaaccaaaagactcacaagtagtatctaaagatgaaaaataccagatataatatccaaaactgggggaaaaactggatgtgattaacagcagattagacactgcggaaaaaaagatcattaaatgtgaaggtatagcagtagaacctattcacactgaagcacaaagagaaaaaaaatactagaacaaagttaatagaacatcagtaaccttgggacaatagcaagttgcctaatacatgtataattggagttccagaaaagtggggaaaggtagaaggcaattactttaggaaacagcgtctgggtggccaggtgggtggctcacacttgtaatcctagcactttggggggccgaggggggtgcagatcatttgagatcaggagtttgagaccagcctgtccaacatggtgaaatctcttctctactaaaaatacaaaaattagctgggcttggtggcatgcgactgtaatctcagcttcttgggaggctgaagcatgagaattgcttgagccagggagatgtaggttgcagtaagccaagatcatgccactacactacagcctgggcaacagagtgagaacctatctcaaaaaaaaaaaaaaaaagaaaaagaaaaagaaaaagaaaataagaaaatagtggctcatcatggtggctcatgcctgtaatcccagcactttgagaggctgagatgagaggattttttgagcacaggagttcaagaccagcctgggcaatttccttaaaaaagaaaaagaaacagtgactataaattttccaaatctgatgataaccataaactctcagatccaagaaactcagtgaactctaaatagaataaacaaatataatcatacctaggtatgtaatgataaaattagtgccagtcatggtggctcatgcctgtaatcctaacactttgggatgctgaggcccggagtttgagaccagcctgggcaacatagtgatacccctatgtctacaaagattaaaaaatagaaatataaaaagttagctaggcatggtggcacttgtctgtaatcccacttacttgggaggctgaggtgggaggattgcttgaactcacgaggtcaaggctgcggtaagccataattgtattccacccagggtgataaagcatgacgggagatcctgtctcaaaacaaaacaaaaccaaaaaaaggcgaggcacagtgactcacacttgtaatcccagcattttgggaggtcaaggtaggatgatcgcttgagcccagaaattggagacaagcctgggcaacatagtgagaccctgtctctcaaaagaaagtttaaaaaggcgggcatggtggcatgggcctgtagtcctgtctactcaggtggctaaggtgggaggattgcttgagcttgggaggttgaggctgcagtgaactgtgttcgtgccactgcactccagcatgggagacagagcaagatcctttgtcaataataacacataaaccaatgttacaatgagaagaaataaattctggtgttcggttttttgttttttttttttctgagatggagtttctctcttgttgcccacgctggagtgcaatggcatagtcttggctcactgcaacctccacctcctggattcaagatgattcttttccctcagcctcccaagtagctgggattacaggtgcatgccaccacacccagctaattttcgtatttttagtccatcacgttagccaggctggtctcaaactcctgatctcaaattctggtgttctattgcacagtggggtgagtatagttaagagtaaaatattattacaaaatagctggaagaggggcttttgaatgttctttcacaagtgagaaatgcaggaggtgatggatacactaactgctctgattggatcattatgcaacatggatatgtatcaaaacatcaaattgtggcccggcgcggtggctcatgctggtaattccagcactttgggagtctgcggtgggtggatcacctgaggtcaggagttcaagactagcctggccaacatggcgaaaccccatctctactaaaaatacaaaaattagctgggtgtggtggtgcatgcctgtaattccagctactcgggagactgaggcgggagaattgcttgaacctgggaggcagaggttgcagtgagctgagattgcgccatcgcactccagcctgggcaacaaagcaagactccatctcaaaaaaaaaaaaatcaaattgtaccccataagtatgtacaattacaatatgacagtttaaaaattaaattaaaaaaaaattctcttgtacttaccagctgaataaaaaataaatttttaaaaggagagaagtcttcttaaaaaccagttatttaccccatcattaagttataatgaactttcttatgggaattctttgataaggaagctcctttatgctgaagttttattcttttcatacctctttagataaatcagtgctttaggagcatatgtcatatgactcaatggcagtgttctaacttggattctagctccacattgtgcaaaggcaaaaaaccagagagtcagtgtggtagttaagaacttatgttctgctgtttgatttcctacatgccagtactccctccactacctgcagtcttcctgacctggggcaagttccttttgtaaactctgttttctagggggatggtggtggaagaaggatggtgatttgagccaggcagtagcaggtagaggtggagaaaagtggtcaaaccctgaatgaacgttaaagataggaccaaaaggatttgatgagaaattggaagtagagcacagggaaaaagaaagatatcagtgatgatgccaaggtttttggcctggggaattgggatagtggagttgttatttgctgagtatgacttttcacaaaggaatgtcaaggcataagtagcaaagttcttttttttttttttttaatttttcttgattgtgtttgttttgtttttcatcttttgtgggaggtgggtggagatgaaagcaagcacaggggttggcaggcatacccctggcacctacctgtgagttcatgattactagttttaaagttcagtcctttttatttttacttttttttttttttttttttttttagagacagtgtctcactctgtcatccaggctggagtgcagtggcacaatcacggcttactgtagccttgatctcccaggctcaggtgatcctttcacttcagcctcctgagtagctgggactacaggcacataccaccctacccagcaatttttttaaaaaattttttgtagcgacatagtcttaccatgttgcctagactggtctcgaactactgagctgaagcaacctgtctgcctcagcctcccaaagtaaagtactgtaattacaagcttgagccaccgtgcgtggccaaattctggccttttgatgttgcatggtgtggatggggaggcaaagtgtgatattttaggaatttgaggatttcttcttcgaccttaggcgtgacattggacaaatgacatctgggctgagacattttctagtaatgctggatccaaaaaactcttatcccattgtctcatagcttcattacacagacctggcggccatgatcctctttttttcccccttagttgccaaacatgggttctctgtcttacctcatttgagtcttacctcagtcttgagagtctcaaatgtgtatcatagtttttagacaaaattcaaccttatttcaattagtatttcattgttatttaaatattttaacaggaaaactgagcaatgtttccctttacctgttaatcctgttataatattttagataaagtgtattagaaggcacattcttcattaatagaatatttattcatgtgtttatatggttcttaactaggaataccatatagtctatctccaaccctttgagaaggaaaaaagatcctgactaaacaggacaccagaagggcatgcctaaactaggactgttctgggcaaatcagaaggcatgttcaccttattctttttattctttctttttctttttttttttttttttgtgacggagtctcgctctgtcgcccaggctggagtacagtgacacgatcttggctcactgcaacctccacctcccaggttcaagcgattctcctgcctcagcctcctgagtagctgggactacaggcacatgccaccatgcctggcaaattttttgtgtttttagtagagacgggggttttgtcgtgttagccaggatggtcttgaactcctgacctcatgacctgtccacttcggcctcccaaagtggtgggattataggcatgacccactgcacctggcctcaccctattcctaaggccagaaaaccagctagagtaaagttcactttctgtttgagtgcttggactttattgggagaaggcaaatgccctggaacaagagtgaaagggagaaattcccgttgtattgcaagccagaataagagaggctcacccacactggcctaaggcatctcagttgttgatgagaatgtgattacagatgtctcacatgaataccaaagacaattgcaaaggaaattaaaagttatgcaaagagagtcgagaagtcagttgtctgctcacaggttggctttagtggctattactttgagatactaaatgagcgatagctttaaacttcaactgcttttgtttctgaggaaaaaaatcatcttatatcctttcataagtcgcataaaaagtggacattttctattattttaaagagtaaatttaggtacaagcatttactaatttttttttttttttttttttttttttgagatggagtctggctttgttgcccaggctggaatgcagtggcgcaatcttggctcactgcaagctccgcctccctggttcacgccatgctcctgcctcagcctccagagtagctgggactacaggcgcccgccaccacgcccagctaattttttgtatttttagtagagacggggtttcacccttttagccaggatggtctcgatctcctgacttcgtgatctgcccgcctcagcctcccaaagtgctgggattgattacaggcgtgagccactgctcccggcctgtaattctttttttttttgagacggagcctcgctctgttgcccaggctggagtgcagtggcgtgatcttggttcactgcaagctccgcctcccgggttcacgccattcttctgcctcagcctcccgagtagctgggactacaggggcccaccaccacgctcggctaattttttgtattttttagtggagacggggtttcaccgtgttagtcaggatggcctcgatctcctgacctcgtgatccgcccgcctcagcctcccaacatttagtaattcttaaaagagttcagcatgaatatacacagtacgtgggttattagtactgtgttgttaacacaaatgaactatgatagcaaattgaatttggttcaatcaggtcaaagaataaaaggatgattttctttaaccaccagcaaaggatagtataatgaaccccatgcaactatcacttaacttcaataatttcaagtttgagtaagttgcagagtagtaatttgaacccacatctctcttgttccaaatcccttgcttttaattacaatcccatgtggcttctttgtcatttgatgctattgagcaactttatgatttttttggtgtttttggtaaaatagacatgaaaaggcattactacagggagttttttcactccctggtaataagaggggaaaagcactctcttttaatgatacatgttttgtaataagcattttttttagttgcagtgttctgcaaagacaaaacctgctgatacagttcatcctgttttagaaatctttgacccattcatcagactctgaccactctaaagataaaggattatggttgtattggtttttccgactgaagcggccttctgcagattgagaaattgtataattattaactgcggtaatggagatgtacttgcaagtttcatctggtatcttaatgacctttaaccctctgagtacacctaaaacatatcctagaattattgaaattaatcagttgtccataacttttctgtctgtataatttggctatcatacgtattttgtttccccctgcccttgccagtttccatcctcctactcacatactcacaactcctataaattggagtatttagtagcagtagcctttggtataaacactttttaaaaatttactattttttgaattaatagggccactttctagtcaagtttttttttttttggggggggggtaaggagggtagggtaacagttccacacttacaagggtatttgtttagaccaagcttgttcaacccacagcctgtggggctgcatgtggtccaggatggctttaaatgcaactcaacatgagtttgtaaactttcttaaaacattatgagttttttttgagaatttttttgagacagagtctcgctctgttgtccaggctggagtgcagtggcccgatcttggctcactgcaacctccacctcctgggttcaagcgattctcctgcctcagcctctggcgtagctgggattacaggtgtgtgccaccactccaagctaatttttgtatttttagtagagacggggttttaccatgttggccaggctggtctcaaactcctgacctcaagtgatctgcccacctcggcctcccaaagtgctgggattataagcatgagccaccgcgcccagcctgcgatttttttttttaagctcattagctatcattagtgttaactgtattttatgtgtggcccaagacaattctccttcttccgttgtggcccagggaagccaaaagattagacacccctgatttagacaaataagtgaaggcacactgaaataacagttatatataataaccttgtgccacccagcgcggtggctcatgcctctaatctcagcactttgggaggctgaggcgggcggatcagctgaggttgggagttcaagaccagcctgacttacatggagaaaccccatctctactaaaaatacaaaattagctgggcatggtggtgcatgcctgtaatctcagctacttgggaggctgaggcaggagaatcgcttgaacccaggaggcagaggttgcagtgagctgagatcgcgccattgcactccagcctgggtgacaaaagcgagactctgtctcaaaaaaaaaaaaaagaaaagaaaagaaaaaaaaaacacaaaaaaaccttgtgttttgtggatctcacattcatctcagatatttcttgccctgggagatcctctgaattctcaggactgcttcgtgtcatccctttatgctctactatcttcccttgcctagaaggcaagtagggctttgaatctcgcctttgattctactgtgatcctatcaaatatagtaatgctagaaatataggtctgaagtttgggagagagattggctcagtatagatatgtaaagcacagctggatatgtagtagttatatgaatgggattggatgaaattctctagaggtgtgtggaatggaaagaggtggcccaaggaggaagagagagagagagaaattggagaggtagaacaatttaggaaagagtaatgttctagaaactaaggagagagtttcacaactgcagtggtgaagcactgtgagttcttatttggcaatttggacttcattattgtcttatcacagataggaaatgaaaggttgcagaacatttaggagaaaatattaagtgaggacacagaagcagtaaatgtcgtatatgccttttaaacattttggagattacccatagtaggcctgtcccttgggtaaggcaattagggcagctttcctgggccctattttggggtggggaatgactcggggactttattatatgactttttttctgaacattaataaaattcagttccaaaattttgtgattaactgtagtcctaagagcctatgaaaaatgcagataatgggcagttccacattggttgaactgccccaggcttctctcttctagagatgctgtcccttccttttaatcctgtagtagctcctatcacttttttttttttttttttttttttgagacagagtcacccagactggagtgcagtggtgtgatctcagctcactgtaacttctgcctcctgggttcaagcgattctcatgcctcagcctcctgagtagctgggattacaggtgcgtgccaccacacctggctaattttcgtatttttatgggattttaccatgttgcctaggctagtcttgaactcctgacctcaggtgatccacctgcctcagccgctgaagtcctgggattacaggcgtgagccaaggctcctggcctcctgtcactttttacaattgtcagtttgtttttcctctcagaaattaagctccttaaagctctctattattgttttgaattcccagggcctagcataatgcccagcacgtaatgttgagtgtttgttatgtgagtgattgaaggaataatccaatacatatctgtcttaagtacaaaagaattccaatatggtggtctcacagagtcaaaaaagcggaatgtttcagaaaagagggattgataaacagtttcaaatggtactaaaagtattgaaaactgacctttggatttggcttctagaaggtcattggtttccatagtgaaaacttttatagcaaaatggttggagtagaagtggttgaagattaaaggagaaatgagatgtaagaaacaacaaacaagtttgtgggggcgggggggttggttttatttttaaagacttgtagctgagcgtgacagtatgtatctgtagtcccagctatttgggaggctgtggctggatgatagcttgagcccagcagcttgaggctgcagtgagccatgattgcaccattgcactccagcctgggtgagagagagagaccctaactcaaaaaataaaataaaataaaataaaataaaataaaataaaataaagatttgaagctaaagggaagaaaccattggagaagaaagccaaagatctgatggaggagaattcattatcatggtaatgttatgcatttgatttgcatatatctaagtattcccaccaacatgttttttttttttttttgagacagagtctcactctgtcacccaggctggagtgctggagtgcagtggcacgatcttggctcactgcaacctcccgggttcaagcgattctcctgcctcagcctccctagtagctgagactacaggctggtgccatcacgccctggtaatttttgtgtttttagtagagatgaagtttcgccatgttggccaggctggtctcggactcctgatctcaggtgatcctcccacttcggcctctcaaagtgctgggattacaggcgtgagccaccacgcctggtcccaaccaacatttcaagataatatatttctccttccacttgggtttgatatattaatgtattttgaacttgaaggcttttgctgtgctatttggggcccctagtggtaaatctaataatgacatgcaatagaacagctaatataccagttattccttatgaaggttattctttctatgaggattaaatgaggttggaatatgtagttatagcaatagtagtgattcttaatcatttttttaaaaagagagtctcgccaggcacgttggctcacacctgtaatcccaaaactttgggaggccaaggtgggtggatcacttgaggtcaggagtttgcgaccagcctggccaacatggtgacaccccatctctactaaaaaaaactaaaattagctgggcgtggtggtagacggctgtaatctcagctactcggtaggttgagaattgcttgaacctgggagacaggaggttgtagtgagctgagatcgcgtcattgcactccagactgggtgacaagagcaaaactctgtctcaaaataaataaataaagggtctcactttgttactcagactgaagtgcagtggtgtgatcatggctcactgcaatgtccgcctctcaggctcaagtaatcctcccacctcagcctccctagtagctgggactataggtgttccaccactatgtccagctaattttaagaaattttttagtttttaaatttttttgtagagatggtggtcttactatgttgtccaagctggcctcaaactcctggtctcaagtgatcctcccacctcggcctcccaaagtgctgggattaccggtgtgagccaccatggctggccaaaaatgagtaatttttttttttttgagatggagtctctctttgtcgcccaggctggagtgcagtggcgaggtcttggctcactgcaacctcctcctcctgggttcaagcgcttctcttgcctcagactcccgagtaactgagactataggcacgggccatcacagccggctaatttttgtatttttagtagagatggggttttgccatcttggcctggctggtcttgaactcctgacctcaagtgatccacccccttggcctcccaaagtgctgcgattacaggcgtgaaccactgtgctctgccccaaaatgactaatttaaaggtgactgtaatatagttaaacaaatgcctcttttcccattctttactaacttgttatttaaatggggcaagtttttacaacataagaaacaggccaggcgcggtggctcacgcctgtaatcccagcactttgaaaggcagaggcgagtggatttcttgaggtcaggagtttgagaccagcctggccgacatggtgaaaccccgtctctactaaaagtacaaaaattagccgggcatggtggcacagactgtaatcccagctaatcagggggctgaagcaggagaattggttgaacctgggaggtggacgttgcagtgagcctagatggcaacactgcagtccagcctgggcaacagagcaagactccatctcaaatgaaacaaacatactaaaaacctattaacttgtttgatgtgagtgtgcttagctttatttcccttaaagagagtctttttatgagatggagtctcactctgttgcccaggctagagtgcagtggtgcaatctaggctcactgcaacctccgcctcctgggttcaagcgagtcttctgcctcagccttcaagtggctgggactacaggcgtgtgctaccacgtccagctaattttttgtttttagtatagacggcgtttcacgctgttaggcaggatggtctcgatctcctgacctcgtgatccacccacctcggcctcccaaagagctgggattacaggtgtgagccactgcgcccggcctaaagagagtctttaggtgaaaaatttttgtgaatattgtgatttctccttaataatttcttgtgtatttatgaattttatataattaaatggcatatcaaaaaaatcacctatgttaattatgtttttgactcagttatattttcttttggtacattattaagttaatatccatatgcaaaaatatgctgacaatatattaattttggatttttcatttttatcagaaatcatgagtggaggatctcaagtccacattttttggggtgctccagttgcttcactgaaaatgacagtatcagaagacacagcttctttaatgtctgttgctgacccctggaaaaaaattcagcttttatacagtcaacattctttatatctgaaggatgaaaaacagcacaaaaatcttgaaaactatgaagtcccagattctattggttctccagatctttgtggtcatttcttagcaaactgtatgaatagacatgttcatgtgaaagatgactttgtacattctgtttctgaaacacagaatatagaatcccagaagattcactcctctagactgagtgacataactagctctaatatgcaaatatgtggatttaaaagcacagttccgcatttaaccgaagaagaaaagtatcaaagcttctcagtgaaaataaaattagagatgaacagcctaaacatcagccagatatatgtggtcagaactttaacacaaatttgtttcagttgggccataaatgtgcagctgtgttggatttggtttgtagtactgaaaaaattaatatagggcctgaagtggtacaaagagagtgtgtgccaacagaatatcatgaaatacaaaaccagtgtttgggattattttcctcgaactcagtagataagtcaaggtctgaagcagcagttaagaaggtctcagaccttaaaatatcaactgataaagaatttctcagtataattacctccagccaggttgctttttttagctcaaaagaaagataaaaggcggagtcctgtaaataaagggaatgtaaacatggagactgaaccaaaggcaagttacggggagataagaatacctgaagagaattcgattcagcttgatggttttacagaagcatatgaaagtggacaaaaccaagcatattcccttgaactttttagtcctgtttgtcctaaaacagaaaatagccgcattcacataaactctgataaaggtcttgaagaacatacaggatctcaagaacttttcagttctgaagatgaactgccaccaaatgagatacatattgagttgtgtagctcaggaatactgtgttcccaactaaataccttccacaaaagtgctattaaaagaagctgtacctctgaagataaagtgggccagtctgaagctctatctggagtccttcaagtagctaagaaaatgaagttgatttctaatggaggagattctgctgtagaaatggatcggagaaatgtgtctgaatttaagagtattaaaaaaacatcattaataaaaaactgtgattctaaaagccagaagtataattgtttagtcatggtgctatctccatgccatgtgaaggaaataaacaaaattcggaccaaattctggctctaaagtgcctttagcaacagttacagtaagtgatcaatcagaaactaagaagaaggtttttctgtggaggactgcagcattttgggcatttacagtgtttcttggagatataattttactcacgggtgaggtcattatggtatagtggtagcttattttataaagctaagttttgtttgtttttgtttttctcccacttagtctttgaagactctttctttagtcatttgcctcttctgagctcagcataattgatccctttattgcatctgcattgctctcctttccattgtccactctcctgcccattgccacttctgggcctctgttctatccttctcagctctgccccttctttccacttatcccctcctttaataagccttccctagtcaggtggagtgggtcacacttgtaatcccagcactttgggaggctgaggcaggaagattgcttgaggccaggaatttgagaccagccttggcaacacagaacccgtctctacaaaaaataaattaagttttgcgtgcctgtagtcccagatacccaggaggctgacatgagaggattgcttgagcccaggaggttgaggctgcagtgagctttgattgggccactgcactctagcccgagcaacagagttagacctttctgcttctttacctaatgtctaataatgctgtgcacattgtgtttttactgtgggaacagttattgatttctgttgccttattttattatcaaaattatattaattacacttggaaatatggaaaggaaaaaactggtattataccaacttcatataaccaccaatagagttcgagagtgttgccttccagttattttctctgttctccttaaaatgtgtgtgcatgtgtgtatatatcacacatagaagctcatatttattgggagcttagtttgtgagaccctgttttagattttacatgcatatttcattacaacaagtatatgaggaaggtactgatttttatccccacttttcagttgaggaagctgaagcccagagaagtaaagtaacttgtccaatgtcatacatctaggaagtggcaaagctatagtttctcctagactccagaatttatactcttactatatagttgtaaccataaagaacattttgtttttttaatttttaatttatttatttttaagagacagagtcttgctatgttgccaagtgcagtgggtactcacgggcacaatcccattactgatcagcatgagaatttttgaattgttatttttaattttttgtttgtttgtttaataaggacaggatctcactgcattacccagtctgatctccaactcctgggctcaattgatcctcctgccgcagcctcccaaagtgctaggattacaggcgtgagctaccgtgcccatggtatttttaacatgcccttgtttccaacctggaccagttcacccctccttagggaacctgtggtcctccactcccaggaggtcactatattgatggcaagcttagtgcaaacacctgatcggctacaactctgaactcctgggctcaagtgagcctcctgcctcagtctcccaagtagccaggactacaggcacgcatgccgctgcacccagagagaatatttaatttttttttttttttttgagacagtcttgctctgtcacccaggctggagcgcagtggcacaatcttgactcactgcaacctccgcctcctgggtgcaggtgattctcctgcctcagcctttcgagtagctgagattacaggtgcaagccaccatgcctggctaatttttgtatttttatagagacggggtttcaccatgttggccgggctggtttcgaactcctgtcctcaggtgatccgcccacctcgccctcccaaaatgctaggattacaagtgtgagccaccgtgcctggccagaatatgttttcatcgaacacatctaacattgtgttacgtgttctttgttgatttaaaattgacacatggtgtattagagcaggaggaagttgattaagcttaataaaatatctaaagaaagaatgtgatacagaggcggtatttagaaaaagaaaacttcgaagcaatattgatagtcctaccaaatagtttacaggaggaatgagaaccttagctaatgtacttggtgttcctgtaggattgtcaagtacaatctttttttttttttttttgagacggagtctggctctggcacccaggctggagtgcagtggcgcgatgtctgctcactgcaagctccgcctcccgggttcacgccgttttcctgcctcagcctcccgaatagctgggactacaggcgcctgccaccgcgcgcggctaatttttttgtacttttagtagagacagggtttcactgtgttagccaggatggtctcgatatcctcacctcgtgatctgcccgcctcggcctcccaaagtgctgggattacaggcgtgagccaccgcgcccggccgagtacaatcttttataaagaagtaaacacaaaattgtaatgaacaggcttagcatagccacatcccactggcagtattagctaatattatttatatgtgattatattattggaggttcaattcacctaactccctctgttctgattcagtgcttgctgaatacctctttgcttgtgatttggctttctagttgtagagctgcccacagcatgagaacaggctgaaatactgtttttttggggcaattattgtaaatgaaaaaaaaatgtttttttttctttaatttgtttcattaattgatttagtatgagcttatgttgcagagctgaaatctagttttggagtgttaacaaaattaagtttcccagactgtaaaagagggctggatcctggaccatggtcattttaccgaggcaattaatgtcagcagggacctctcaggggccttttcctttttcctaggtaggtgtaaactcaactctgcaatctctgtattttttcctaacatctctatagttgttaacgactaggtaacattctctctggtggctgtaatgcaatttacttaaccattttcctattataagacatttagatgatttctatgaacatttttttaaaaaatcagattttttttgtctttttaagaaaaagaggatctagttcaccgatttctgaataagtttcttttgtgtggaacagatggaaatgttgggaaaaaaaagaaatctacacttttctgttgtcctaatgaggcagtgaacttagttggatagcttgggtagtttatactacctattgatatatacccccaaacagaaatcttcctttttttttttttttttttgagatggagtcttgctctgttgcccaggctggagtgcagtggcgtgatctcggctcactgcaacctctgcctcctgggttcaagtgattctcctgcctcagcctcccaagtagctgggactacaggagcccgccaccacgcctgactaatttttgtatttttagtagaggcagggtttcaccatattggccgggctggtctcgaactcctgaccttgtgatctgcccacctcggcctcccaaagttctgggattacaggtgtgagccagcgcgctcggcccatactgaaaaatttgaagtaacagatgtattccagaccttgttgaataccaacacagtagacagtttgctattataacttctagcaatagaatgaagagatgccaaaaataaggattacctaagggagactactgactagaattagaagaagatgggaggcttaacattgggaaaccacagtgtttaaaggacaaacagaataaggactaggagctggggcatgtcagtgagagggtaggaaggagccaggaggccagggtgggctacccatcccctccatgcaccactagtgattaccatgtcactaatccaacataggcttcacagtcctagctttcagaatgctctccttgaaatttcttgtctgttccttttttctgaagaacatgcatcctgaatgttggatcatgaaaagtcttgaatgctgtactagctcttcctggctaggcagtggggaaccactgttttttagtaagtcacctgaactcattaatgctctgatatatcactcgcctgaactcattactgctctgataaatgactcattagcattgtaagaaatgggttgcaggcgggacaagcacctgttgggagggaaaggaatgtgtaatgtaaaacagtagtagtggtggggcatgggcacatttaagcagcagaggggtaggtgggagctggtggcaaggagtgggaagggagaggcaagatgacttcagattttagtttacttgattagcagcatagcatcaataaatgagttgggcgctatgaaaggaaaagcagatttggacattgctgagtttggggagccaatggaatatccaggtgggaatttccattaggcagttgtagataaaaggttcaaaagctgaggaaagggtctggaatctaaatctgtaagtaatcacttggaatttatacatccttggttttctttcctattatctctaaattatttcactattgttaatatatgtttatacctctgacactgtatgctgattagatcctgccttagagatagctcccttcccctctttctctttacagctcacatgttttgctctacctacaattgtttctacctgttggtatgtttagttctacctgattctactctatccgtcttagatatacagctctctctttccaattggaaaatgttccctacctccaaagtctttcacttttaacttatgtggaagataattatcgtgctatttagggaaaaataatcaagtgtgttatattcagatatatttatagtagaagggaccagtgcatactgaatattattactctcctaggcactacggctttggaaccactactttgccttctggtcctaaaaaaaattatttttgatgtatcagaaatatacatgataacattttccttatgtaaataaaaactattaaaccttttttatatagagcagtggacttccatactgctatcatttgaatataaagaagaaattttgttaatttacctagatttagattttagatttgctgttttgtcatttcgtgcccttaggcaggttatttaacctatttgatctctagttgcttggtatatgggaggcatgcataatattttgctgtgactagtaggttaaccacattgtgaaggaatttatggcatgatcagaatgttttttctctctctagatgttgttattcatgaggaccaatggattggtgagacagtactacaatcaacatttagcagtcagttattaaatcttgggagttattcatctattcagcctgaagaatgtaaggcacattttaaatgaagtaatgtattagtgtttaaagtataaaaacatactaggaaagattagggttaaaatggttcttttacaaaatgttttctaaacagttggagagtattggtttcttttcattagtaagaatgaaaatagaattttaagaaatgaacttgtacattgtaaatcacatttattttaagaagtattgggtctcatgtttcgttttcttaggctgtcagtatagtggtggttcttcaccttttagggagtcagagacctctttgagaatctatagaccatttctccagaaaactggacttatgtagataggcacaaaattttgcttataattctaaagcattccgtggacctctgaagttcttctgtggaacttctgagcctctgattaagaatccttgaggtaataaaaatgtattggtctcgtattcagacagctgtggtttgaatccttattctcctgtctaccactgctaagaaaagctatttttcttctttaatgtccagttttctcttctttaaaagaagctgtttaatgaggaaactagcagctatctcctcctctaggaaataaaataacataaaaaaaaagaaagaaaacaaagtaagggaaacagtataaacttgtggttttggtcactggactcagatagaccaggatttgaatcctggccctcttacttccagtctttgtctttaggcaagttatttcacttcactatacctttatctccttttctttgaaatggagataaaaatacatatataccttatagggttgttatgaagattaagtgagaaaatgaatataagatgttgaacctgcacataatgtagtagtaacatagtaatattagagggagaaataataagctagcaaaatatatttgataaaatgctgaaatatcatacaagaaaatagctagagaaatatactgattatacaagaagataactggaataataggaaagttataggatgtatatggaagatagagcatggaattccaatctttgaattcttaaagaaaggcagagcaagtagaagggaagagcaacaattagaataacaagaactgtgtttgggatgggcaaggtttcattatatactagggtggcccatcagcagaaaaccaactctgacatatttcatagacaactcaaatagagttcttcatctatccaatatatatttattatgtgttgacattgtttcaggcactgtgtttactgtacactgggggtacaatggtgcctgtcctcctggagcttatgttctcatgtggaagacagaccaaaaaaaatgaatgaaacagacatataagtaaaatatttgcaggtgataatgagtgctatgaaggaaactaacaaagggttaagatacagaatgccatggttctagttgagaaggattgatcatggagtagaatcagggttaggaagttgttacaatagctgcagttgagagataatgggaggccagtggagctaaagagccgagatatatttgtaaatagagttaataggattttctgatgatgtgggtctggggatcaggtaagagggacaatctactgctactggattactggtttaagtaactaggtagcctttattgggaaagactgagagggaactggtttgtggggaaaagggctatgtttcaaggcatgttaagttttagatatctttgagatattcaagtggagatgtcatataagaactggaaacaaagttcaggactcagaagacaggtttaaaattaagaggcaaattttagagttattagcatacagataatatttcaaatttaaaagtttttaaaataaatattatctgtataattatagaatcacaggggattgcaaaaataatacataaagtcccatgaactcttcttctagcttctcccaatggtgatatcttatataactttagtacaatatcaacaacaggaaatcaacatttgtataatactgttaactagtaatatactaggatactttccctttcagtatcaataaatatagtatcagcctggcacagtggcttatgcctgtaatcccagcactctgggtggctgaggcaggaggattacttgggcccaggagctcgacaccagcctggatgatatggtgaaacctcatctctactacaaatatggaaaaattagccaggtgtagtggtgcacacctgtagttacagctactggggaggcttaagtgggaaagaaagttgaggctgcagtgagccatgatagtaccacagcacttctgcctgggtgaccagagtcagaccttgtctcaaaaaaaatttttttcttaaataaataaatatagcatcaatacagcattataatatgattaatactatatcaataaaatagatacttagtcctaatgccaatgtcttatttaatagaaaagcactcgaggcattgtcattaaaaccaggaaaaagataaggatgtccactatctctgcaactattcatcttatactagaattatcagctaatgcacttagacaagaagaggcatctggtctggtgcggtggctcacgcctgtaatcccagcactttgagaggccaaagtgggcggatcacttgaggccaggagtttgggaccagcctggccaacatagcaaaaccctgtctgtactaaaaagatgaaaaattagccaggtgtggtggtgcatgcctgtggtcccagctactcaggaggctgaggcatgagaattgcctgaacctaggaggtggaggttgcagtgagcacctgtacactgcactgcagcctgagggacagagcgagattctgtctctccaaaaaaaaaaaaaaaaaaaaaaaaaagaaagaagaggcatttgaacatttgaatggataaagaagaatgaaaattatctctatttacaaatgctctgataacatacctgaaaactccagggaatcaaagttaaaacaaatttaaacaataagataattcaatgatataacaggatgcaaaattaatgttaaaaaatatcattaggctgagtgcagtggtttgcgtctgtaattctagccctttgggagatgaaagtgggtggacagcttgagcccaggaattcaagaccagcctgggctacaaaaaagaaaaaggaaaggaaaaagaaaaagaaaaaaatgctgggtgtggtggcacacacctgtggtcccagctgtttgggaggctgaggtaaaaggattgcttgagcccaggctgggggatgaggttgcagtgagctgtgattgcaccactgtactccagcctgggcaacagagcaaggccctgtctcaaaaaaaaaataataataatagtaattagacaatatacacaaataataaacagagggcataatgatagtgaaaaactcatttactatagtaataaagaagatagttcaaaatacagttaacaagaaatatgcaaagcctatatgaggaaaaaatttaaacactccagaaagaaatgaagacatgaataaatggaaagacattccctgttcttggataggatgactcaacattataatgatgtcagttcttcctaagttaatatgtaaattcaatgtagttccaatgaaaatatatatgttgtggcatataaaagttgatactaaagctcatatgggaaaacagacatgcaagaatagctaggaaaagactgacaaaggaaaactacagaggaggggaactagctttaccagatgttaaaacatactataaagcctctgtaattaaaacagtgaagtactgatgcatgaatagacaagtagaccagtggaacagagtaagaagattagaattagacccacctacatatagcaatttaatatatgacaaagatagtatctggaatcagtgagataaaagctaacttcttaataaatggtgctgagacaactgggtagccatttggaaaaaagggaaaattggacacatatctcacaacaaacagtaataaacaccatatggattaatagtctaaatgtaaaaaataaaatcatgcaacaacaagaaggaaacctgaatgaatcctctgtaatcttggtgtagggaaaggctttttcttaatattactcagaatccaggggcagtagaagataaactgatacattttactacagaaaaataaattttgcataaccaaaacactataaacaaagtcaaaagacaactgacaaacttggagaaaatatttgtaacatacaacaaaaggctaatatccctaatatataaagaacttttaaaccttgagtgacaaagtctgggtgtggttgttcacactggtaatcatagcattttggaaagctgaggtgggagaatcacttgagctcaggagtttgagtccagcctgggcaacatagtgagaccctgtctctacaaaaagtcaaaaaattagccaggtgtggtggtgcatgcctatggtcccagctacgtaggaggctgaggcaggaggattgtttgagcccaggaggtcgaggctgcagtgagctgtattcatgccactgcactctagcctggcaaaagggaaaatgtgaaaaagagatgaacagtcaattttcaaaaaaagatataaaaatggctatcaaatataacttattagagaaattcaaattaaaactacatggagataccatttctcacctatcagattggcaaaattaaaaaaaaaaatcacattctgttggcgcaactgtgaggtaatgtgccctcttatacattggtggtaggaatgcaaattgctacaacccttttgaagggatatttggcaatatctaacaaaattacatatgtacttagctttcaacctagcaatcccacttctaggaatctaccctgaagctacacctccaacaatatgaaaatacatatcagaaggttattcattgcagtattgtttataattgcaaaatatataggagaatgattcactaagttatggtgcattcacatagtggaacactatgtactatgcagctgtacaaaaagaatgaaaaagatctctacaaactgatatggagtgattcccaggacatactgttatgtgaaaacataaaccccccaaaactatatgtagtatgctgtccctcctgtaagaaggaatggaggaataagaaaatacctctgtttatttgtggaaagaaaatgcaggaaggataaaccagaaactaaagagattggtcacctacagggggcacgtaggagaggggtggaagaaagtggggaatgggaacaggatagcaggggtcaggaggaagtgacactaacaaatgaatgtattattgttacaaatgaacctaatattgttacaaatgaataaaataactacatagaagggggtggggaagaaaagaacaaacctaagtagctgtggaaaagagtatattgactggattctataaggctaatgacagaaaggactgtacataaatgctgcaatctagttagaaatatgtttctcaaaggcgaatggcttagcaataaccttatgtacatactagaatgaacaaatgagtacatagattgcagataaggaaagctggatttctcactgttggagaaagaaattataaacaagggaaggttaaaacgaaccagaggtatcgttataaactgaggatttttaatatagataaatggatacagaaatataggcatgtgtatatgggtgggatagtacacatacataaacatctcctagttctgtccattgagcgagcacagcacagatgcagttactcctcagtaataatgagcatacctggtgcccagatcttcatctgtaaacattttcttttcttttcttttctttttttttttttttttttgagatggactcttgttctgtcacccaggctggagtgcagtggcgtgatcttggctcactgcaacctctgcctcctgggttcgagcaattctcctgcttcagcctcccaagtagctgggactacaggtacgtgccaccacgcccagataatttttgtatttttagtagagatggggtttcaccatgttggccaggctggtcttgaactcctgacctcaaatgatctgcccactttggcctcccaaagtgctgagattgcacgtgtgagccaccgtgcccggcctctcgttttttttgagacagggtctggctctgttgcccaggctagagtacagtggtgcgatctcggcttactccaacttccgcctcctgggctcaagccagcctcccacttcagccttccaagtagccggtaccataggtgtgcactaccacgcctggctaatttttgtatttcttgtagagactggatttcaccatgttgctctggctggtctcggactcctgggcttcagcagtccacccatcttggcctcccaaaatgctgggattacaggtgtgagccattgtgcctggccaacatagttctctaatgaaaggaaccagctctgctaaaagtggttgattacaggactgggtcagggcaaattcaggataagcctggaagtctagtggtgccagacaagacatgttgaaataatgcaagagccaacctgaaggaacacctactggctaaagctgaagcaatttgagtaagaaaataatgatagtattggattagaacccatagattaaaatctttacaaatccttattgatataaagatatatttatttcattaactaaccagaggggaagagaaagctcttccttccaatggaattccaattaataaatctgagagaaaagaaaaaaaaatagagaattactggccatgctcagtggttcatgcctataatcccagcactttgggaggctgaggcaggtggatggcttgagcccaggagttcgagaccagcctgggcaacatggcaaaaccccatctctacaaaaaatagaaaaattaaccaggtttggaggtgtgcccctatggtcccagctattcgggaggctgaggtgggaggattgattgatcccaggaggttgaggctgcagtgagccgtgatcatgccactgcacttcagcctgggcaacagagtgagactctgtctcaagaaaaaaaaaaaatacaaaacacaaaaatagagaattaccatcaggcagagatcacaatcataaatactgcacggacacaaatgcactgatagatgctaaaattagtaggtgaaagtctgaggagagagagcattgcatagtctcaaagtatctccccaggataccagcttactagagggaaaataataaatttataagaaaactcttcagacaccaagttaactgagtgattggggtaaatatcaccagtaataagatgtatggtatcataaattctttgatattatccattgagaaggatccaccatattttttgtggaattgccaaaaatgcataacttcattccaatcataaaacactggagaaacccaaagggaaggacgttctactaaataattgatcaggattcttcataagtgtcaaggtaatgaaaaagaaaagactgagaaactcttatagactagaggagaccaaagagaaataacaactaaatgtgaggtgggatcttggatgaaatcctacatagaaaaagcatattaataggagaattggtaaaatttaaataacatctacattttaattaacaatatttaattaacgttagtttcctgtttaagataacttataatatgtgagatgcccacattagttgacatagtgaggaatataagggaactctgtactatttttgcaacttttttgtaagtcttacattagttcaaaacagagtttttaaaagagctgtatacgatcatctcaataggtacaaagaaagcttttgataaaattcaacacctgttcattaggaatagaataaaattttccttaacttcataaagagtgtctttagaaaacccagaacaattatcatcctaattggaaaaatattagaagcattccttttaaaattcaggaatatgactaggatactactattactacttttcttcaacaccatattagagttattaaccagtgcaataaacatggaaaaatagatatgtaaagattggaaaggtagaaataaaactgccattattatagatggtttacataccttttccctctgaaaactacaaacaaattattagaaataatgtgaaaatttagcaaagtagctggatataagattaacatacaaaagtcaatcacatttctagagtagagcgactaacaataacaaaggaagctgccattgacaacaatattattttgtactaatagtaataaatgtagcaaagtatgtgcaagacctaaaaaaggaaaaatttttaaatgaagaaaaactaacaaagaatgaaataaacatatactttattcattaattggaagatttaacattgtgaagatttcagttcttttcaagttgatttgtaaattcagcgcatgttcaataaaaatcctcgtaagatttcaagggcgcagtggctcatgcctgtaatgccagcactttgggaggccaaggtaggaggatctcttgaggcaatgagttaaagaccaataagattttcatgtaatttgataagattgtatgatatttatgtagaagagtaagtggttgaaaacagcagggcattttaagaagaaaagcagggaagaataatttaccctatcagctatcaagacttagtatgaacctatagtaactgagatggtgtggttttgcccagttgaagtcagttaaattttaattttgagatttctgtaaaagatacaagtttagtcttttattatgtatatttgaaggtgttacattttggaaagtgtgtgtgtatgaatgatagctaaatggcttctaagtaaaattcagcatatcttgtagatgttgatagaatagaaggggaaggaatgttttgaaataatgaaaataacatggtatgcaaatgctttgcaagagatttgggaaatgtagatatctctggttttaaggatgatctagattcaagtaatagttcagtaatttcataaaactcttatgacaaaattctggatggagaatattctatgaatcccctagagagtttcaggtttttgtagaatgatgtgaaaaatcttgaactaattagataatctttagaagttacttcacaatctttgtttttacacatacacaggaatttatggtgctttattttttacaggttagtagctaaataaagtatattctaaagtttttttattgatgtagggaaatggctaccagtggacattttgagaatattgcagttgtttttcttctgaaagagtaaaccgggtcatgacgcagcgagtttcagtcgtgacttttctgggggcatcgcggcgtcccctttttttgcctttaaagtaaaacgtcgccccgacgcaccccccgcgtatttcggggggcggaggcggcgggccacggcgcgaagaggggcggtgctgacgccggccggtcacgtgggcgtgttgtgggggggaggggcgccgccgcgcggtcggttccgggcggttgggagcgcacgagctagcgagcgagaggcagccgcgcccgccgccgcccctgctctgtatgccgctctctcccggcgcggccgccgccgatcacagcagcaggagccgccgccgccgcggttgatgtggttgggccggggctgaggaggccgccaagatgccgcagtcaaagtcccggaagatcgcgatcctgggctaccggtctgtggggaaatcctcattgacgattcaatttgttgaaggccaatttgtggactcctacgatccaaccatagaaaacacttttacaaagttgatcacagtaaatggacaagaatatcatctttaacttgtagacacagccgggcaagatgaatattctatctttcctcagacatactccatagatattaatggctatattcttgtgtattctgttacatcaatcaaaagttttgaagtgattaaagttatccatggcaaattgttggatatggtggggaaagtacaaatacctattatgttggttggaaataagaaagacctgcatatggaaagggtgatcagttatgaagaagggaaagctttggcagaatcttggaatgcagcttttttggaatcttctgctaaagaaaatcagactgctgttgatgtttttcgaaggatgattttggaggcagaaaaaatggacggggcagcttcacaaggcaagtcttcatgctcggtgatgtgattctgctgcaaagcccgaggacactgggaatatattctagctgaagaagcaaactgcccgttctccttggagataaactatgcttcttttttcttctgttaacctgaaagatatcatttgggtcagagctcccctcccttcagattatgttaactctgagtctgtccaaatgagttcacttccattttcaaattttaagcaatcatattttcaatttatatattgtatttcttaatattatgaccaagaattttattggcattaatttttcagtgtagtttgttgtttaaaataatgtaatcatcaaaatgatgcatattgttacactactattaactaggcttcaatatatcagtgtttatttcattgtgttaaatgtatacttgcaaataaaatagctgcaaacctcaaaaaaacaaaaaaacaaaacaaaaaaaaagagtaaaccaatttggttactcattttaccaatttggttttgattttgcaagtggttacaactcatgagaggattcttatttctgatcaatatattgtgtttttggaaaggacttctgggaaataattatgatgaagccctcgagcaattgcaacaaaaccaaaaattgaaaagtgggacctaataatacttttttaaaatttattttttagagacaggatctcactgttacccaggctggagtgcagtggtctgatcatagctcactgcagcctcaatctcccaggctcaagagattcttctacctcagcctcctgaatagctgggactacaggtgcatgcccccatgcccagctaatttttgtattttttgtagagaccaggttgtgtcatgttgcccaagctggccttgaattcctgagctcaagcgatcctcttgtcttagcctcccaaagtgctggaattacatgtgtgagccaccactcccagccccagaacaactattattaaaaagtcaaaaaacgacagatgttggtaggctgtgtagaaaaggaaatgcttgtacactgttggtgggaatgtaaattagttcagccgctgttgaaaacagtttggggttttctcaaagaagttaaaactgaactatgatttgacccagcaattccattactaggtatatatccaaaagaaaacaaattgttctaccaaaaagacataagcacttgaatattcattgtagcactattcacagtagcaaagtcatgcaatcaacctaggtggccatcagtggaggattgaataaagaaaatgtggtacatatacaccatggaattctacgcagccataaaaaggaatgaaatcaggatggtgcggtggctcatgcctgtaattcccacactttgacaggctgaggcaggcagattgcttgagtccaggagtttgagaccagcctgggcaaggtggcaaaaccctgtctctacaaaaaatacaaaaaaattagctaggtgtggtggtgcacacctgtggccccagctatttgggaggctgaagtgggaggatcacctgagcccaggaggtggagtttacagtgagctgagattgtgccactgcattccagcctgggcaacagagtgacaccttgtctcaaaaaaataaataaataaataaataaattgcagcaacacagatgcagttggaagcaattatcctaagtgaattgagggaggaacaggaaaccaaataacgtgtattctcacttataagtgggagctaaacactggctactcatggacatagaggtggcaacaatacacactggggactactagagggagagggttgaaaaactacctgttgggtactgtgctcagtacctgggtgacaggatcacttgtaccccaaagttcagtatcacgcagtattcccaggtaacagacctgcacatgtacacccgaatctaaagtaaaagttgaaaagaaaagacttctgtactttcatctttatagtgaggtgttacatgttttacaaacctagttctgataatgtgacaggaatataaatttatcttgaatattattaaatatataagtcaaagatcaacacagtgtttccatgaggtagactttttttggaatctaaataaccatgtgtttccacgtaaatttttatgaatcagggacaaatatataatttgatgtcagagatgtttttgttccccaaaagctctatcttgttcatgaaaaacgaagcccagagaagttatgtacaagttcacagagctcattattgacaaaaccagaatttgaatacaactcttctgattccagatttgctggaaatactgtgaaagaagaattcagtctggtagtattacgtgtggttttaattttttctttgtaactttagtttgaattttatgtgtgtgtgagcatctgcatttacttttaaaaacttttattgtaaaagccttcaaacatatacaaaagtagagaatacaaagcataatgaacttaagtacctattagccagcttattaaaacatggtcagtcttgtttcacctgttacatcccttttcttttactgtctaaaggaaggaaagaagaatcacaaatcagtttatgaagtctgctttctaaaaagtacttaagtgtttattgccaatatcttattttggtcggcaatcaatcacatactcaagcatacttctcttaccttcagagaaattaaaatttaatcagcaaaactcatcagcctgtacatttaaaatatatgcatgttattgtacagaaactataccttaataaaaagtgagaaaaaaaatgagacaggaaagagaaaaacatttaaaagacatagtaactgaagaattaaataaccaatccaacacttgaaaaatattacaatgtagcacatgcttaaaagctctctgagctcagggaaaaaagcagcactgtgaatctatagtggtcatcattctatgtggtattgggtaggacaagaagacagccttgcagctggaaattggtgaggacggaggcctcgtgtggaaagagtaaggcacactcagggagagaaccagtgaggtggctctgagcctgtttcagaaggggcttgaggaagaacggcagaggctaggatagttgggaaagcaggatcaaatcagactccagggattggggaaccaattggctgttacagggtggtggagtcaaaaaagaacagaaattttgtgtttggttaattgatagaaaatgatattattaacaaagtaaagaagtatgggaacagcacaagttttttggggatagtaaataattccatttccattgattaaaaatatcaagtttatttttacatctaaactgattcaagacttagctattgtacatgttttagagaaaacaaaactatattttatatctaatcatactttacaacataaaatacagttctaaaaaatattatttgtcaagaaaaatataatgttgccatcttttgtctgtatgcatgttttttttccttagattccagcgtagttagtgacgttgtacttcaagacttactggcatatgtgtcctcaaaacattcctacctcagagatcttcctccgagacagcctcagagggtgaacagtatagactttgtagaattggagcaccttcaacctgatgtgttagtccacgcagtactaagagttgttgatttcctatactgacaggtaaacattttgactgcctccttaattttagattatgaaaaaattaagatacaagaccatcttagtgtaccatttggttatcactatatatgtatcatcagctattaaagtatggtatcatgtgtgatagagtaatgccaactaagatactcattttccttttccagaggcagtatacagttatagaggacagaagcagaaaaaagttatgttaacagtggaacaggcccaagatcaacattatgcgcttgtattatggggtcctggagcagcctggtaccctcaacttcaaaggaaaaaaggtaaatacaccaaaaagcatttaacctatttatatttcggtaaatgattaatgtttatgagcccaagatggagaaaatcttaagagacgagacagcatttgaaatacaagtgatcatgattgaatattcttctgcaaatttcttctgttaaaattttgtacctcttgtagcaattcatttatctaataagtcttcattaattaatggtggtgaaataaaggcttaaatttattcccagatatactactttacctttttagtgaagatcttacctccttcaaataatgttctttaaacatttaattctggagaagcttctacaattttttttcagccagagtactctgataaataaatgctatgattataaggcagatgtcaagggagttaccttaactctttcaagtcacaattaatgttcaataaattacagtttcatatttttattatagttgttttaaaagcatgcactgttagccatccctagaatgttcagtgttaaaatatgacccatgattacatttttctttaaagcataaattatttctggtatattgaattaaatggaattgatgtttcattaaaatagtatagtgtcttccctttgctattgtgagatcctttagttgtaacaatcaaagacagtttcatttgtggcttatgagttatttttccctgctaaattaatttagagattgattcagtatattattattttttacctgaaagagttaatgtctctccaaacttctgccttccaaatagttatttgtagataggatctatcacattgtctctcttaatcattaatagctatgactaggatttgagataagtctaactttggacttttatgttaagatcaaacagggacagatgtttgtttggttgagcaagctgacaaacatgtatcagtgatagactaactatgatcattgaccaccatagcctggctgagaacatgagtctagtgcatgctacacaagaatgtaggtcacaggtatagtggagctgtaacagagcagattgctccatgtttaatgtgaatattcttttaaaattaatagttttttggttaatagaagagaaattacagttgtctctaggtgactctatggtgtttaggttagtattgaaaacgtatgaatccaggaattaagatgttgttgttctttgtacattcattcatccagccccccttatttgtaaccatcattttaaagttttaacatctacttcaatacctcacatcagtctttttaagataaaaataccaattttgaaggattacttaagtaattctattttcctgattttacttttcttttcaagagaccaaccccatttccaaattcccagcaaagagaatctgattgcccagagtaaatttgattcaaaaaactgtgatcaggaagacagggtcacgcaatacaaatatgagagcttgagcttatttcagtggatgggaaaacagttaagggaatcatttgtgatctgggtgaatacataaagatattcactaccaaaaatgtgtatgttcattagcttagaaagatatatgtaatgtattatttagtttaaaaagtagattataggccaggtgtggtggctcactcctgttaacccagtaccttgggaggctgaggtgggtggattgcttgagcccaggagtccaagttctcatcttaaaaaaaaataaaaaataaaaaaaattggattgtaaaacttcatgtatagaaaatatattatgttatcatataataaatatttttatgtttatataagttaatacacaaaaattttcaagaaaaccctttatatatgatagtatctcattttaataaaaatgtatctataagtacatatgtgcatttgaaaacctggaaatatgcatgtatagcaaaatgctagccgtagttatttctgtatagtagtattatatgtgctttaatttttttctttatacctttagtttgaatttcatatgtgtgtgagcatctgcatttacttttaaaaacttttattataaaagccttcaagcatatacaaaagtagagagaatactaagcataaggcactttttttttttgtttgtttgagacagagtttcattcttgtcacccaggctggaatgtagtggcatgatctctgctcactgcaacctccacctcctgggttcaagttattctcctgcctcagcctcccaagtaactggaattacaggcatgtgccatcatgcccagcttatttttgtatttttagtagagacgaggtttcaccatgttggccaggctggtctcaaactcctgatctcaggtgattcacccgcctcagcctcccaaagtgctgggattataggcatgagccagccaccgcacccggccagcataatgaacttcggtacctattagccagcttattaaaacatggtcagtcttgtttcacctgttacctccctcatctttactgtttaaatatttcacaataaatgtattttattttataattaaaaataaaattaaaaccttatgctttttaaaataaaagaatagttaatgtttggaaaatctagctaacaatgtgagaaaaaatagaattaaatttatactttatatttgtgccaatataaatttcagatacattagagattcaaatacaaaaataatgaaacaatgaatagtagaagaaaatataggcaaaattatttgtaatgcaaaggttggtagggtaaataaaatccaggaacaaaaactattatacataaaaaccaccatgtacaaaattgaaaggcaacaaaaaaaaaacagaaaaaaaattacattgtcagacaataatgcagtaagcaaaagacacatatctatagagttaaatggggaaaggatatgagtaggcaagtccccaaagaagaaataaaaatggccaataaatatatggaaaaattgttcttacaagtaattgaaaacacacaaagtaatgatgatagattatttttcttttaagaaattgattgagaagatatgggaaaacagctactgtcatcagctattggaaatgcaaactggcagaacctttcttgaggataactgacaattaatatgaacaaattgggggtacttttagcccaataattttagctctaggaacttatcataactatgtataaagatgtagctgaaaatgggtttatcatggtatcatgtataattgtgaaaaataaaaaacaaccagagtccctcaaaatagaggtttgctgtaataatttttaagattttggtgtatctggacaatggcatattatgtaatatttaaaagcaatgtagaataatacatacatataaaactatatttgacttattaagtcaatcccaataaataaaatcccaaacaactggttgtccgctaaaatgttaactgcttatttagggtgttgagattatggctgctatatgtttatttacttggcttctcttagcttacttttctaatcaggtattttgtaataagacaagaaagctattttagtgattggttttaagcagtaacttggaatatatgctttagttctagctagtgatgttctgtctttacagatttactgagatgtttgatgattttccaccaaaaaaaaaaaaaaaatctttagtgaaagaaactaaggagatgagcaggtgtagtaaattagatttatggcctgaagtgagaaactaaaaagacagctgatgttatcagaaaaatgagtgctaagaaaccctcttttgttttattatagttttgaagttgaatttactaatacagaatatgataatacagataagttgaatttactaatagagaatataacagtaacaaggtctgtgttactgtggctttaagtattagaattgtggccggcgcggtggctcccgcctgtaatcccagcactttgggaagccgaggcgggcggatcacgaggtcaggagatggagaccatcctggctaacacagtgaaaccccgtctctactaaaaatgcaaaaaaaattagccgggcgtggtggcaggcgcctgtagtcccagctactccggaggctgaggcaggagaatggcttgaacccgggacgtggagcttgcagtgagccgagattgcgccactgtgctccagcctgggcaacagagcgagactccgtctcaaaaaaaaaaaaaaattgttactgagagttaaaaataagtactattgtgtctaaatgctttttgttctagaaaagttaactaagataactaaagtattgaaatatgagtgaaatattagacttgggttcatttcagtgtcctttctttaacaaaacaaaacaaaactttgcctatagatagatacatgagaattttctttacagaaagcagttggttattataaatgatgaccgttcaggagggcaaggaatctttagaaaatattttattaaaattatctctggtggcccggcgcggaggcttatgcctgtaatcccagcactgtgggaggccgaggtgggcggatcatgaggtcaggagttcaagaccagcctgaccaacatggcgaaaccctgtctctactaaaaatacaaaaattagccgggagtggtggcacgcacctgtaatcccagctactcaggaggccgaggcaggagaatcacttgaacctgggaggtggaggtttcagtgagccgagatcacaccactgctctccagcctgggcaacagagcgagactctgtcttggaaaaaaaaaataataataataatctctagcatgcttctgttgtcttaatgcaccattcatattttgtctctgtttacccaaattctttagtgataaaagattagtattcaactgacttaatcagatcaatctatttaatctgatactaagcctagatttttttttcctttttggtgacttttgtttttactgtttttgtttaaggttatatttgggaatttaaatatctttttgttcagcgcaattacacactagaaaacctagaattgcatacaacgccttggtcatcctgtgagtgcttgtttgatgatgatataagggcaattacatttaaagcaaaatttcaaaaaagtgcaccctcctttgtgaagatatcagacttagcaacccacctagaggataagtgttcaggtaagatttttatatacataaattctgctatttttatttcttttgaaacagagtcttgctctgttgctcaggctggaatacagtggtgtgaacacagctcactgcagtctccacctcccaggtttaagtgattctccccgctcagcctttcgggtagctgaggagggaagggaaggctagtgcataccatcagtgcatgccaccacacccagctatttatttatttattattttggcagagacagagtctccctatgttgcccagtctggtctcaaactcctggactcaagtgatcctcttgccttggactcccaaagtgctggaattacaggcatgagccaccacacccagcccactgctagttttaatataagcaaaaaggctaccacttgtggtaaaaatgtataagtctatataaaagtgaaatataaatctttgcaaatatctgaactagattccagtagttttaggaactatgtgctaggaaccagggacaaagagcaaatacctattttttattatatgacaagtgggagcagaaattcagatccttactttatcttggccaaatgccagattaaaatgttactagttgggttaattcacatatatgtgtaaatatgttttccaatatatgattgaaggttagcattgttatatcataaaactatgctaaggagaatacaggcagaaaacaaagacaatacctctcaaaaaacccaacttttaattgaatacagagatttcattctcagagaagaactccttattcttagttctacactgaaacatttactaataccagcagatagtttaaattaataatatttctggaaggtaaacacagatgatagaaaatttataagcttttatactataaaaatttcatactattttcaaaaatggaagttgcctatggtcataaaagactctagatttatactaactggtaaaatcttggtaatgttatagcatcatgtaagttcctaagccagttttatatttatgtgcccctcccgtgctctgcttctccaacttcacagacatatagaggtggtcaccacaggaaggaatgccagacacagttgaggggctaccttactttgcagagacgtttagtttggtgccatggagaagtcaactctgttatttactgcttacacaaaacagttatctgctgggattgaagtctagaattaggtttaaaaataaaaataaataacatcatggacaacaacaaaataggaggccaccacgctgatgatgaaagattctcaggctatagccccacttgtttgaggacgcagccaggaattgtgcatgttcttggaagtcctggaggtgtgctcctcattagcaagccatgccaaaactgtgccattaaaatcagtccttcagaggctttgttcacagaggcctgtttagcctttttcattctctttatgttcagctatgagggctgaattcatagtttctgtcatagtgtatgtgtttttaagacaaaaatggagagagaatatgaaaacacaagcaacttttccctaacctattttatagttaaataaaaggagaaagagagatcagcatgggagcatttcctagaagggtctgcttgctcaacaaaagccagagggggatgaggctaggcctgagtccttgtaaagaaatgaagacgcttacccagtacctcatcttaccgccagcagaatttcagtgctcagccggagtgacccccttgaaagcaaagtccacattcagcgtgaccttttaattcttttcaagagttgtgtaaatttacaaaatgataggattatgtgaacattcttttaaaattattgaattattacgaattttttaggctgggcagggtggctcatgcctataattccagcactttgggaggccgaggtgggtggatcatttgaggtcaggagtttgagaccagcctggccaacgtggtgaaaccctgcctctactaaaaatacaaaacttagccaggcatgatgtcgggtgcctgtagtcccagctacttgggaggctgaggcaggaaaattgcttgaacgcaggaggcagaggttgcagtgagccgagattgcaccactgcagtgcagactgggtgacagagcaatactctgtctcaaaaaaaaaaaaaaaaaaaagactttttgagtggagggaggagagcaagggttgaaaaactaactgttgggtactctgcctactacaggagactacttgggtgatgatatgcccatgtaacaaacctgcacatctaccctctgaatctaaaataaaaatcgaaattttttttttacatatttttttaggccagacacattggctcaagcctgtaatcccagcattctgggaggccaagaagagtggatcacttgagcccaggagttggagaccagcctggtcaacatggcaaatccccatctccacaaaaaaatacaaaaattagccaggtgtggtggtgtgtgcctgtagtcccagctactcaggaagctgaggtgggaggatcacttgtgcccagggaggttgagactgcagtgagtcaagattgcaccactgcactctagcctggacgacagagtgagactgtctcaaaacaacaaaaaataataattttgtagtgatttaacatgtctttggaaagatgtggtattgaatcttctacagtttgttacatattcgatcgctacgcactcctgctaactcatgtagggatatgtgacacaattggaagagatgatgaaaccgtctttgggcattgaaagactaaagcaaatgaagttaagaacagaagactcatcattaactggactctgaaagagataaccagaaaacagtaggagactagagtgattagttcttgacctggagtgttcttacttctaagtggatgaagaagaacaaatttgaaggcttaaggcttaaagaagcctttaaattgactatggagaaagggagaataatgctcaagaaaactcatagacctcaccagtacacagtaagacaaaagtaaattaggaaaaaataatgtctgggagatagtagactttcagtatttgtttactggtgaatggatgagccattagcagtgaattatgaatatgcttgaggtttcttgtgagtcacctgagaaacgattaataaatgagaactttttataacccacagccagagtatatagatgataatggtgagcggaaagttggaaaaaagtttaaaagagaacaggctattgatatttttacgtagagagaagaagaaaagttcacctcctatttggcttttttttttttttttttttgagacggagtctcgctctttcgcccaggccggtgtgcagtggtgtgatcttggctcactataagctctgcctcctgggttcaagccattctcctgcctcagcctcccgagtagctgagactacaggcgccagccaccgcgcccggctaattttttgtatttttagtagagacagggtttcaccatgttagccaggatggtctcgatctcctgacctcgtgatctgcccgcgtcggcctcccaaagtgctgggattacaggtgtgagccactgtgcccggcccctatctggcttttcaccatgatcagtttaaaagaagacagggcaaggagagagggcatgttagctagtttcaagtattcgaagggatttcttctaaaggaggtattgaacttattttgcctgattccagaggatggggaaggaaggaaacatcacatgttcagccaaattagccaagtaaacctgctctcagttgcagccagacctccctgcccttagattctaggaaaatagtaaagaagacgaagaacaagacctcagtgtatccttttactacaagtgactgtaaatcaactataaaattagccatgtttgtaaattaaagttataattttggcccaataatttataacatatctgtttgttgtttgtaggagtggttctaattaaagcccagatttcagagctggcatttcctcttacagcagctcagaagatagctctaaatgctcacagttctctgaagagtattttttcttctcttcccaacatcatatatactggctgtgcaaaatgtggattggaactagaaacagatgagaacaggatctacaaacaatgttttagctgcttgccatttactatgaagaaaatatattataggtaaggcaactaagcaagccaatttgatggaaaataattattatagatctggaaaaactagtctgtaaactcttactttctaaaaagaattaactagagctagtcgaagagaacaaaattttccctgagtgatagatagctatttatggtagcaaaaattacccaggaatcgttataggaatttcttaaagataggaatttcttaaagcagtaattgggagattttattgtcttcaaacagctgtaccaaagaaacattttccttggtttactttttaaccaaaatctaaatgctcataaataactcattttcccaccttaacatataattagaatttaaaggctaaaagtaccatatgatgtcacctctgagttgttgtggaagctagtaagacatttaagctgttttcccacctttaccttagaaattaaagctagcaaataaatgttatatggtaaaactgctaatcagctcagtgaaaaacacattgttttttgaataataggtagtcaaaagctcagacatttttctctttaccttataaattacatgtgtttacaaaatagcactcagtgttttatgctccttatgattatttctaaatattgcggtatctaaaaactaaattcagatatattccacatgttatcatggcatacttcaagaaaagttatagaagcttaatttgtaaaccttatttctctttacagatattatgtttgttataaataagtgaatgaattttgctattactgtgaaagttgcttttgtggaaaagaagattgaattaagatgtatggtaggctgggtgtggtggctcatgcctgtaatcccagcactttgggaggctgtggtggggggatcgctggagcccaggggttcaagaccagcctgggaaacacagggaaaccccatctctaccaaaaaaaaaaaaaaaaagctgggcatggtgacataggcctgtagtcccagctacttgggaggctgaggcgggaggattgtttgagcccaggagatcgattgttacagtgagctatgtttgcaccactgcactctagcttgtgcaacagagtgagaccctgtctcaaaatcaaaacaaaaaatgcatggtatgtaacaaacaacattgatttattaatagttaaggcccctcaaaagtatgtataggtgacttatttatatcattccaaatgtttctattcaacataagcatttattggacaaaaatgttgctcaatactattccttatggggaggagggcctttgaatctttagtttacaaaatgactgttcaagagaaggacttcacagatcagtatcacctgattatggcataactagtatggggtatttaagatctcttcctaaactataccacattaaagatgtagtgctagtttgttgtcttactagaatgttgaatggtcatgttaaggcaagaattattattttttatttatttaaaagcctttttttttatttttttgagacagagtttcgctcttgttgcccaggctggagtgcactggtgcgatctcagctcatcgcaacctctgcctcccaggttcaagtgattcttctgtctcagcctcccaagtagctgggattacaggcatgtgccaccacgcctggctaattttgtatttttatagagacagggtttctccatgttggtcaggctggtctcgaactcctgacctcaggtgatccacccgtctcagcctcccaaagtgctggaattacaggtgtgagccaccaagcccagcctaaaagcctttaaattattagagtccagattatgtggtttccttggaaagaaaatattgaaattaacaaactcccttcaagttatcaagtatgtgactccaaaatcatctacataaatcaatcagcaaactgaataagagaaaactctcattgattatttttctaagactcagtcaaatatttattaggaatccacgtatgttcacatatcacatgtgtactgtggatgttatactagttgatctaagtagacttattgtgcccaagaagcttggtagtccatttaagaaacacttaatgaacatttgtgtggcacaacagtcccaaactatgagtgggttgatcatattttacattggttgtaacttggagctgattttccaatggaagcaacattagatattgcaatggagtctcatacgaggccacagacatttattaaattaacatgtagatagcatagttcctgctcttcaagctatcataaaactcaaataccatttttaacaatgtttctacagaatattcagatttacatttttggaatacaagaaatacatttatttttctgtactggaagcaaaaaaccccagcaggtcaaaccacaattaaggctcctatttaggcagcactaggaaatgtttgggtctctcaagaggttgtagtcaaggtgtaggctggggctgcagtcatctgaaggcttgactggggctggaggattcatttccaaagtggctcattcatatggctggcaagttgagttcctcttcacttgggtgtctccacgggctgcctgaatgttctcacaaagtggcagctcatttcctcagagcaggaaaggcaagaaagagagttccaggtggaagccagcctttttgtgacctagactcagaagtcatgtggcatcacttctaccaaattctgttcatcagaagtgagtttagctgtgcgttggagagtggattagaatgaagctagtgcagagaagcggtaagaggctgttgccttattttggagaggagatgatggtggcttgactagagaggaagcggtaggaataaaaagaagtggacagatttgagaatggtcagaaaatagtttgcaagatgtagtgattggtaggtaaagagagagcacaggtacattgcaaatcattgacagttgggtgaacaataagattatttattaaaacaagtaaccttgggagaaatcttgatcatattgagcttgagttcctgagaggtaacaagttggaaagtggttagatgtaaagaaatgcaatttgcaagagaagtctgggctaggcttataaggttatctgtggtgattgaacttttccttggtttctgcaccctgttttgtttttccttcttaatcttcagtgattacctctcataatggattattcttactagcctataaagacagtcccatatttctcttattaaaaaacaaacaaaatcatccattaacattacatctccctcttatcccttcgtttttctattctgttttatacccagccaaactttgttaaagagttgtaaatatactctctctcccctattatgtcttcagtttcacttcagttattccattctactcctaccatgctgcagaagctgcttttgtcaaagttacacttttgatgttgcctgaggcatggatacttctttcctcgctctaactgctctcagttatattcagcatgtcagtccacttcctccttcttgaaacagcctcctccttgctttctaacctgtctctcaggcccttctttctcagccttttctaccccctctttaaatgctctcgtctgtgtccttcctcttattctttctgtacattctgcctggatgatcacagctgttttcgtatttgtacttaacatcttcaccctgattttctcctccaggctccagtagtcaggtatcaaattctttgcttgatgtccatctcacatttaaacatacccacaatagactcttgtttttcctaaaaccacactcaaatctagttctcttcgtttttatactttctggaaaatggcacaccatctacccaattatttaggctggaaacctgggcacaatcgttgcatcattttctcttccctacctcccctatctaatctattagcaagtcctaggaattttcattcagaactatatcacaaattcatccacttttttccatctccactgctaacatcttagtccagtgtatcccagcaggggcattgttgacatttttctcaggacagtttctcattatgtaccatatcccacatgctgcggggcatgtggcatccctgtttaccttcccctagctgaacctcaattactgtgaaaccaaaatggaaagtcagtgcctgctggtctggaatcactcaggcctcatctgagtccctactacctgttgcgcaaaccagcacaccagcagtctcttggtggggctcctcctggccttgcctcctcccctttattctccacccgttggcagtgtgattaccctttgcttcacccatcagtcatctccttatgcttgtttcctctgcagtctcatctgctgccactcccctgttgtccagcactctagccacgtggccttctttcagttcttcagacattttgatttttctccttaggatgttctcgaatgtcttccctctgactccacaaggctggtttcttcatgtcttagattaaatgctgctttatcagagaggcctctcctaaccacccttctttattttctgttatagtagcctgggtgtgcttactgtaatttgtatttgcatactgtcttttctaaaaaacatttttactgaagttaaaattcatataccatcaaattaatcttctgaaatgtacaattcaatggcggtagtatattccaagggctgtgtagctatcaccacaaccagttaggacattttcattacccagccctttacaaagcctcatactcattagcagtcactctccattccccatgcccctcaacccatggcaactacgaatctgctttctgtctctatagatttgcctgttctagatattttatataaatattatataatatgtgatcttttgtgactggcttcacttagcatgatgttttcaaggtccatccatgttgtagcatgtatcactacttcattcctttttattgcaaaataatattttattgtatgcacataccacattttatttatccattcatcagttgatggacaattgggttgtttctactctttggctattatgaatgatgctgctgtgaacatttgtgtacaagtttttgtgtggatatgtgtgttcatttctcttgggtatatatctaggagtggtggaattgctgggtcatatggtaactgtctgtttaaccttttgaggaactaccaggctgttttccaaaattgctgcacaattttacattctcatcagcaatatgagggttgtaatttccccatattcttgccagtacttcttattccgtttttctttttgttgcatgtgctttcgggtcatatctaagaaaggtgtcatttctaagccaaggttatggagatttgctcccgtattttcttctaagagtttagtagttttacctcctacatttaggtttattatctactttgagttaagttttgtatatgggataaggaaggggtataattttattttttggcatgtggatatctagttgtcccagcgtgaatttttgaaaagactgttccatccctgtttagtcatcttggcaccactgttgaaaagcttattttctttcttcttctttttgtagagatgaggtctcgttgtgttgcccaggctggtctcaaactcctggcctcaagcagtcctcctcaccttggcatcccaaagcgctgggattacaggcatgagccaccgcgcatgcccaatttcttcctatccctctacagttttacgttccttgagtgacggaaccagatttgtctttttcactagtgggtacccagcacttaccacagtccatgatagatactcagtttgtatttgttgaaataaataatggagggagagagaggctgaggaaagagtgtagagtgaaaagaggaaggaacatagagtcatcgtgtgaataaagggggaagtgggtttttagggggaaaatcagtagttatgttttagctctgttacattaaattcccccgctaatgagcctgtttctgaattctgttctcaatttattttttaaaaatcaatgtagttataaaataggtaccacatgccatggttaaaatgcacactacataggaggttataaaacaaagagtgaaagtctccttcaccatccaaccctctcccaccagtgctgcttccatgctggtgagaaggttttttgtatgtccttccagtgatttattatgttcatcccagcacatgtgtatccctttctttagaagcatgtggacagaagaatattgttcatattgttgttccctagagtctatcctggtgctccttccctaatagcacttgcaaatgttcttcattctttttatcagctacatagcattaagatgtaggatgcactgaaaattgttaatccagttttattgatatgcaaaacagtttatttctgataggaaagaattcagttgaaaaaagtaacttgaaattgtgattgtgaaatatgtgattattatttttattttcatttctaaaaacaatttataaaacagtttaatatatttttatattagtatctgaaatttaaaaatggatatagaataaataaaatgtagtaatttatcatttgaagctcttggggaaaaaaaaacctttttttccttctaggatgtcacagaacatcctagagttgttttaagcattaaaattaatcctgcattaaaaaccaagtgctttttggaattatttttcatttaaacatttcttttatttgaaaatctttttgaaggtcgtgtgttgtttactcttctgtaggccagcgttaatgactgccgttgatggaagacataatgtttacatccgtgtagaatcaaaactgatagagaagattcttctcaacatttctgcacactgcctcaacagagtgataggcaatatatcagtgtgccatcaagaagttgttttattcaggagtataaatggtatatcggaacagaaagagcactctactttaaattaagagcttttctgtccatatgaaaacagaaggataatttagcttaagtgaaatataagcctatgtaagttagaaggttgacttgctttacacctgttagtacatgaacagtgggaggcacctaatttcttcttaacctacatttcctgttggtaagcaaaaactattttacttaactctagttttataagaatgaagtcaatgagtgtatgacataatatatatgaagatagtccagtgtcagtggaatggatttgcaagatcttcaaccatgatgtcttagttgtcagtggctaagaataaagcaaagataatatatttgtcaggtattcaaactccattcctgttctcattagcctcagatcctctaagctgatgagctaatctggttctgtgattgctttatctttcaatagtagattgtttttcgtgtttttttttagttgggggtgtctagtaattttgggttgaatgctgaacgttgcatatattaagtagaacagtacaaactgaggtaaatagtagttgtacctggaaacaggcatgcctcttctggtcctttactggaggtgaggggtgagcaggatggtcagccttgtcataagttgagttggattcaggttttgttgtttctctggttaccttcaggtcaccactggtttcaaattatcttgtgcttatggtgggaagtggttccccagtattcctgctccaccatcagcatagccctccactctgcacctgggcctcagagaaagtttctttccatattcttgcacctccccaagttgcacaagcttttgttggttgttatttggtgcatcctaacctggtgggtgggagcagggttgttcctctttgattctggtccagccccagtcttatacggatgttgcacatggcgctttcttggtagccctgtcccttatgtggcatggcagctgagctctgtcttgtgcctttagtgggtcttgtgtggtcctggccctgccccagcagtaggggaccactaatggtcttgacccagggtggtttttcagtcctcccccaggatggaggtttttttttttcttttttctttcccccatctgtactggttcctcacctgtaccctggggcaacaggatttggtgtccctcctccagcaattgaaggcttttgttccttaaaggggaggccagatggtgctttgtgttttgtagttggaagctttctctgatgtcttgccctgcccccagtcttatgagcacctggtggaggtgagacgtactatgtggaagagcctatgaggatgcagatgttccttatgttgctgacactggcagttcattggctttttgcaattaatttattaataaaaattaatcacattcttctttcctgcctgtatggaggacctgtcttcttcccaaggcctgccccaagggaacctgtgctcctgttccatctccctggaggcacctgtctccttatgtttcagtctttttggctgttttacaaccttggttctcatgtgtattcaagaaaatgatgattttatatttattcagttttttccagtaactgttagggtaggagccactttttccagctttctacatcttaattagaagcctctctccgttttttcccccattttctttatttcatttttattcttttggctattttcattccttttcttaatgttacttatatattttcagtgttatctcttctttttttttttgagatggagttttgctcttgttgcctagactggagtgctgtggcgcgatctcagttcaccataacctctgcctcctggattcaagcaagtctcctgcctcagtttcccaagtagctgggattacaggcttgtgccaccatgcccggctaattttgtatttttagtagatatggggtttctctatgttagtcaggctggtcttgaactcccaacctcaggtgatctgcctgcctcggtctcccaaagtgctgggattacaggcgtgagctgccgtgtccggcctatctcttcttttttgcataatgtaaattagtctttatctcttagagaagcataattctcatatcacatatacttcagtgttttgtccattcttgagacaattaaagttgtacttcttggcattaattagattgtgatcataagtcaaaatgtcattggtcataaagtggtcatcagaccatgcagactattactaatattggttatgttttagtttattgcagtgaaaatacaaaatttaaaagttattgtagagaattatcataccccccaaaatatgtcattggtcctccaggactctgtagtccccatccaagaaagactgtgataattgtcaaggggttagtacggtctgagcatggtcgatggtgctctgtcattctggtattgaacaacctcccaaatgtcttgattacatgtcctaaaaaagtgaggggaagagtgtaggacaaatgcaaaataaaataacacatttagctatacttttagtattttttattattgagattcaatatttaagtgaccgattcaagattcttttatataaaaaatgaatatatgcataagtaactgtgataagaactgtggatggataagagcactcgtctgatgtactgcagcataaccagaactgctgtcggtctgaacggtgtgttatctgggcctgtttcttgtgtcagggggatcacatgccgtcactctggagtgcctcaatagcttgtaactagaaagagaaggtatagaaagagtagtttacttacctgtttatttatttagaggcagagtcttgctctgttgcccaggctggagtgcagtggcacaatctcagctcattgcaacctctacctcctgggttcaagcaaatctcctgcctcagcttcccgagtagctgggattacaggcatgtgccaccactcccggctaatttttgtatttttagtagagacagggttttactgtgttggccaggcatgtctcgaactcctgacctcaagtaatccagccacctccgtctcccagagtgctgggattacaggtgtgagccaccgctactggccgggaggagaaatttaaaatgggtttgagacttgaggaaccaaaagaaacaatgaaaccattcaatgtgtgtgctcctgtcaagctagcagcgatcttgagagctctgtgttttcgtcttctgcagttccttcctcagagatcacctatgggatggttgtggcagacctgttccactccttgttggcagtcagcgcagaaccttgtgtattgaagattcagagcctttttgtgttagatgaaaacagctatccattacaacaagatttctccctcctggatttttatcctgacatggtaaagcatggagccaatgcccgtctctgaggccagaggaagaaattgcaggcatttcaaggaagaagtactgaaatgatttgtcttttgaaataaatgaatgacagggcttttgctttggattttttatgaaatatattttacaaagagaattgcactagataaattaaaacttttttctaagaaaatcctgtgaggtttaaaaagattgtttttgtcttttggtttcttcctttcttctggagaaatgatctaccagtcaaggcaatatgtagcagatccctgggaattaaaggtttgcccatttgttcactgtatttagtccctgctacattccaggcatcgtactaagtatggggaaccacagagaagacactccttcagaaactgctgcagtgctttcgcttatccctacctaaaaaaccgtcaatgtgaaatcatttccttgattataactataatgataatggattagtttatataaacctatgtttagacaagttcaagacaagcgtgtctttctataaaaagtattgaaagtgaaggaaatgagatcatgtttcaatttattaaagcagggaagagcgttctgtggttagttcgtgtctaggatttgagtgccttactgaatgtatttaccagcaaacatgtagcaatctgttctctcattgtgattgtggaagaagctcatgtaaaatgatagtcattaatgaggaagtatggcgtggtacttattctgtaagctcagagtatgctgagtgttaatagattgtcatattgcctgaaaataaattcatgatgacatgaacaagcttcttttaccctgtgtatgtttttaaaaattcctttggttcagaggtggttgttgttttttaacttggcttccctaagaacgaaccacaagagttttgtgattctttcaaaaataatatgccaaaatgcctttgtgggagcacacacacacaaatgcatgtttctgtggagaaggatccatagctttcaacaaatcctcagagggttctgtgaccaagaaaggtaagaacaaggctttaactgatgagtttctttgtggggtagataagggaattagagcaaatgattgccaaagttttgtctagcaactaataaggtgggtacagaaagaattgactccattttgtatctagagagactggaattcaaacaaaatcattggctcccttcaatgattcgttgaatgggtgatgaaacttgagcctgtagttgacgccttctaatctgtgctctctcaactataaccacactaggcagagatttggaattctgatataaaatctgcccagtcaatataggccaaccaagagagctgttcgcttaagtgtgcccttccccacttcgtcctcaagtggagacctaatccctacatcaaccagaacataatccccaggaagagatggctcttcacatcctattgggaagaaatctttaaaccatttcaggtgagtcaacagatcacaccaacatctcttcacagttgttggtatgtatttcattaattaacacatatttccaggagcccttatttaggttgggaactgtttcctccagtcctgaggaatctgagctatctacagaagttatgagctatttaagtgggatcaggatcagcccattgctcctgctatggtctgaatgtgtcctcccaaaattcttacgttgaaacctcatctctgatggcattcagaagtggggcatctgggaggtgattagatcatgagggctctgcccttgtgaatgggatcagtgcccttacgaaagtggcccgagggagcttctttgtccccttctgccacaggatacagccagaaggtgtcatctttgaagcagagagcaagccctcactagattctcaattttctggcaccttgatcatcccagccttcaaactgtaaaaaataagtttctgttacttataaattgcccagtctgttattttgttatagcacccagaacggactaagacaccttctgtgtgtattctttacctgagttgacaagtaagtgtctttattctgttatgttttcataaaactcagtggggtagccagagtgtcatccagcagtcccatatctggcagtcttatggtgggcatttcagggagacctcattcttcatcttctgttagttcagcttgcagggacagctctcctatttttagagaatcatttttatttgttagtcacttagtttccccagaggtatcctttttctaacagcgttagaggcattcacctttctccccactagtaagatctgtgctgtttcattttacatctttttttttttttttggttgggggaaagggggctgatcatcaaatgagttgacaacattgggtgcatgatccaccctgcagacgttcgctgaatgtctaccatgtgctaggcactggaaatgcaaagacacaaatgtctgccttctgtaagttcacaggcaagctggtgaagaaatatttaaacaaaattatatcagcgccaggattaaatctgtgtggaatacagagccaaggcaaaagaggtaacagtaggatgggtttgttagtcatgactcttggttgcaagtgataaaaacccaactcagagtagcttgagcaaaaaagggggacttgattgactcacataaatgagggtagtaccagcttaaggcacagttgaatccattggcctaaattacctggttaccccaactccctaatttttctttctttctttctttctttctttctttctttcttttctttttctttctttttctctctctctctttctttctttctttctttctttctttcttttttctttctctctccctctccctctctctctctctcatcagaagaggtcttttacgctgttattgcaaaagcatagatgtttctacagagttttgataggataacattttcacagtgattatgaatttacatcgtccctagaattctaaactactgggatctgaggccgtaagttgtttaagagtattctgacattaccttagattcagcaaaacttgaatagttgatcatgcctttcttagaagaaaatatctgtaatttctcagaacaatatagaatgagacagaaaaactaaccatccctatgtgccttattttaagtgatatatttgtatcctgatgggtttctaggtgttggaacacaggtcatgaatcatagaacaattagaataaagtgttcgtctttatcagtagcttaattctggcccttgatttaatgtcaacaggggagaaatgtgtgagaggggatgaggtttgccaattaattgtcattatgtctttggaggtcttgaacctgatttgttattaagaagtgaattctacccacttaaggcatacatttgctaaaggtgacctctctgcttccacgttgttaagaaatcgtgatttttttcaaaacaatcatcagctttacagtttttgaggaaagatctagaagcctgttaaaatggacttaccaggcagggttcagcccaggaaacacaagccactctgggtattctaaacagagagagattaatgtggaattcaggtgtttgcaaaggtattggaaggctggaggagcaggcatcagtctgagctccaggaggctgccacgtgaacggtggattcatgaaaacatcatcattggctgcaatcttagactgaggatgcagctgctggcatcccggcaactgactctcaagcacatggaagctgggagttatttgctgctgcccaaaactcagtccccacagctacacttgccaggaacagtagcttcaggaagatagcctggatttcactcatcttccatattgcacatgtgtgtgtgtttcattgatggaacatgattcacgctgagagctttagctgcaagaaagtttgggaaatatgtcttctctgaggcttttggtctttgcagttcaggagcagttaggaggtgggactggttggttgcagagtgagctgatttactgcacttagtctagcttattaaaggatgagcttataaacaccccaggtaatatcacaatacataagtgctacctaattactgtgtgggtctgttaccaagaatgtctaagtcaagaaattgaagattgtttccttcagattctgcatcctaatgtagaatctttcctattagagtataagtaaattattttggtgtgttatttaagaatatttgtgaataggcttaattaaacaccatgttaagaaattataaacttaaggccaggcacagtggctcacgcctataatcccagcactctgggaggctgaggcgggcagatcacttgaggtcaggagtttgagaccagcctggccaacatggtgaaacctcatctctactaaaaatacaaaagttagccaggcgtggtggtgcacacctgtaatcccagctacttgggaggctgaggcaggagaattgcttgaacctgggaggtggagcttgcagtgagctgagatcacgccagttcactctagcctgggtgacagagtgagactctgtttaaaaaaaaaaaaaattataaacttaaaaaaaaaatgttttcctttaaacaaaaacgcatgttccttgttttttgttttgttttgttttgccttttttgagagacagtcttgctctgtcacccaggctggagtacagtggcacaattatggctcactgtagcctctacctcctgggcgcaagcaatccttccacctcagcctccctggtagctgggactataagtgcagaccacaacaactgattttttattttttgtagagacagggtctccctacattgcccaggctggtcttgagctcctgggctcaaccgaccctcttgccttggcctcccaaagtgctaggactataggcgtgagccactgcaccaggccgtttctttttttttaaaactttggaaaatatggatgaatgaaagtgagaaaagtaacccttctgttattctaccaaccaaagctaattgctgccaacattttaatagatattccttcggttgttttatgcatgtatgattttgtacatgtgtctactttaaaatatatagtctttcaatgttgcccaggctggactcaaactcctgggctcaagtgatccatcacctcagcctcctgcatgtatctacatcttattttattttatttttagagacattctgttaaccaggttggagtgtagtggtgtgatcatggctcactgcagcctcagcctccctgggctcaagtgatcctcctgcctcagcctcctatgagtagctgggactacaggcatatgcctccatacctggatactttttgtattttttgtagagacatgtttttgccatgttgcccaggctggtctaaactcctggcctcaagtgatcccctttgcctcagcctcccaaagtgctgggattacaggtgtagactaccacgtctggccaacattctcattgatagtctttgcacacatctttcattccttctgggaatttattctaagaaaatagaattttggggtcaaagtacttgtatgtatgtatctgtaccaggaaaaaagcagaaattccagtatcaacagataacgagagccacgcagggtggtacatgcctgtagtcccagctactcaggaggctgaggcaggaggattgtgtggcatgagcccaggagttagaggctacagtgagctatgattgcaccactgtactccagcctgggcaatagagcaagaccctgtctctgaaaaaacaaaacaaaacagataaccattgttactattttgttgaacattttccagataccctgatagaagacagatctgtgcatgcacatacacaattttacataaatgggaccattccatataggccagtatctagtgtgtactttttttactccacaatttgccatatacgtctttccaaatcaatcaacatagattaaatcatatcaactacacaggattccatcatttgtgtgtgctcttgaatcctacttttaaaatgttctcagaaaggttatcctgaaatatattcctatcagaagttttccacactctctctaaactgaatggcataagtgaaagactagttgttaggtttaaaaaaggttatctgttttaattggaattttttttttgaggttttctttttcttttttctttttctttttttttgagacacagtttcactctgtcaccctggctggagtgcagtggtgcgatcttggctcactgcaacatctgcctcctgggttcaagcgattctcctgcctcagcctcctgagtagctgggattacaggtgtgcaccaccatgcccagctagtttttgtatttttagtagagacaggattttgccatgttggccaggctagtcttgaacttctggcctcaagtgatctgcctgcctcagcctcccaaagtactgagactacaggtgtgaaccactgttcccagccttaattgaattattttattgctaaagtgattgtacatttgcttcatatgcttatcagtcatttgcagtttgctttttcatattttaccttagaccatttttatgtgggagaagccttttattaaattagtatgttctccttataaagttagtaatttttaacatgtgttgcagacatttttcccaagcttgttatatatgtttgacatgcagaaatcataaatatttacgtggatcaacccatcaatctttttctttattgtttctagattttatggcatgcctagatagcttcttttctactataagattatacacattttcttcaaaaaattttttgaaacatttatgattgttatatttgtatttaaatctttaattatctaaaatttagtgcatggtatgaatggatctaactgattcattttcctaaaatggtcagctggttgtcccaacactattgatttctttctttcccatcagtgacatagatgtgatctttattataatatgaaattattattcctgctagcattacctgtggactttctggtctgtttcattgttctatatttattgctgagccagaaccatacagttagaattattataactttacatctgataggaaaagtacccctatatttttcttcattaaaattgtttttctcagacatctttgcccatctgttcttttttattccccattaagagtatatgttgcagtgttttttagtatattcagagtgtgtgaccatcagcacactcaattttggaacatttcatcacccccaaaagaatcatccatagttacattaactataccaccccacagctcttccttaagaggagctaacagtcgctcctccatacccaccccctttcccccaaccctaggtaaccactcttctacttagtggctgtatagatttcactattctgacatttcacatgaatggaatcatacaatatgtggtcctttgtaactgatttctttcacttggtatagtgttttcaaggttcacacatgtagcatgtatcactacttcattgtttttattgccaaataatattccattgtatggatataccgcattttatgtatctattcatcagttgatggccaactgagtttttcccactttttggttatttttaattatactatcatgaacatttgtgtgcaagtctttgtgtggatgtatattttcatttctcttgggtatgtacccaggagtggaattgctgggttgtatggtttaaccatttgaggaactgccaaacttttctaatgcaggtgcactattttacattcccatgagaatgcattggagttctgatttctccacatcctcaccagcactttttattattatctgactttttgattatagccatcctagtgggcatgccatctgttcttgagataagtttagaatcatttttatcccattgatatttttaatgagattgctttgaatttatggatcatttggacatgttttcagtggttaaggcttactatttaagaagagcatgctttttcaattaataaagtattctttaatgttccttagctttagctttatttagcagtccacatttaaagggtattaactatggaaatttttttttttttgatacagggtctcactctgttgcccaggctggagtgcagtggtatgatctcagctcactgcaacctctgcctctcaggctcaagctatcctcccacctcagcctccttggtaactggggctacaggcatgtgccaccacacctggttaatttttgtattttttgtagagatggagttttgccatgttgcccaggctggtctggaactcctgggctcaagcaatccacctgcctcagcctcctaaagagcttggattacaggtatgagccatcagccagtttttttgtttttttaaatcattgatttcaactatgctctgttgaatcccttttccatcccctcatgtctcacatgcctcacataacttcccaggcattgtgttttagaaagtctggtattgtttaaattctaacctcattttgctcttctccagagcatgtccagctagtcactaaagggacttggaatggggaggagataggtgcacccttcctttcctttgactccagctgttggagctggagggagggcgtgaactggcaccgaggtgaattctccccattccttcccagcttcctgaggcctagctcctccatgagctggggagggagaaaagaaggaaaggggacagtggtacttaccaggcagctaccactgtggtcctctcctttgatggactccgcttttctagccagtacttaactgctgatgccttctgtgcagcaggcgttgagtactcctctttctggggtccatgtgagagttctttcagagctcactcttctatgtactctatgtactcactctatcttatgtacacagttgttttcatgggagatgcagctctgtctggtctttcctgccccctccactctctccaactgtacctcctttctccatcttgcaatctctctctgattcacttcactcgtgctcagacaggcatggagagcaggtcagcaaattcttcacactatcagactttagacaagctaaggaatttccttctctgcatactgtatatagcacagtttgatttatgtaacatcctaatcatactgtctggaagaatcttaccaaaatgatattattcccctacatggggaattagggcttgattttaccttctttattataattatttttacttgatcaaattactaggaaatattcctccacttctaaagaatacaatttccctgtgttagaaagatcagttctggtgtggtggctcactcccgtaatccctgtaccttgggagcctgagatgggaggattgcttgaggccaggaattggagaccagcctggacaacatagcaagatcttgtctctataaaacactaaaaaaaaaaaaaaaaaaaaaattagccaggcatggtgacacactactcaggaggctgaggcaggaagatcacttgagcccgggagtttgaggctgcagtgagctatgatctgccactacactccagcctggatgacaaagcgagaccctgtctctaaaaaaataaaaccaacaacaaacatacataaataaaaagatcacatccaaataatagaaaaagatgatatggttttggtccccaaaactgacatcatgtaggagatattggaactttgtgggtgggagccaagcccattctggtgccccttctctaggtcacgtctatactgcttgtttggattccttggcaaaaactgattatgcaaggcagtaggatgcctggctcaaattgggtcaatcagatcctttttcttggaatttaaaaaaaaattgcatgaaaacgtatagttaaatgcacaggtcttaagtgtacaatttagagttttgacaaatatatacattcatgtaactgaaccccaaacaagatatggagcatttccatcaccctagaattttcattcatccccacttccagtcagtctcctccatccatgatggccaaccactattctgatttctatcactatacactagtttgatctttgtttggacttcatgtaaatgaaatcatacagtatatattcctttgtaactggctttttttaacctaagaatgtttttcaggcttatccatatttttatgtgaatcagcagtttattcttttttattgttcagtaatatatcaatgtgtgaatatattatccattcgcctgttgaaggtcatttgagttctttccagtttcgaactattatgaataaagctgctaaaaacatttttaaaacaagtcttgttgtggacataagtttttgttggggcagggatttaaatagctaggactgagattgtcagtttattggataggtatatatttaacttgagaagaatctgccaaacagtgctccaaagttgtgcaattttacactctccgcagccaaaatggaggcttccagttgttgtacatccttgtcaacatttgagatgtcagtcattttcactgtagccattctagaggctgtaaagtggaacctcctggttttggtttctctttcactgatgactaatgatgcacaacttttcatgtgctcattggccatttgtataccttcatttgtgaagtgtctctcaagtcatctgcacatttatcttattgggttgtttgtctttttactgatcagacatatgtattctagataaaagtcagatatatgtattattgatatttcaaagcattttgttcagcagtagaaatgctggctatatgatttgagaataaaaatacgtatgtaatcgtaacaagaagtcttaaataaattaaaatgtcactattttgaataactagaatatatattaagaaaaataatcccaggaaataaaaaatatgctagtaatatattaattacacataacaaatttacaaaattatattaccatataacagtaatacataattctaaataaaaataatcatgctcacagataaaaccaaaaactttaagagcttaatttattgaaaggaaatgatttaaatatcatgagggaaataaaaggagacaagaagtagtggaacactctactgtgctcctgctgtttgggaagatgtactatacagagttaattcaacaataaacaaagtccctgagggatggcctatacaagttgacaagttgatgtaaaaattaattgagggaattaaacagaaatgtaaatattccaataaccatcgaattatacattttaaatggatgaatcgtatatgtgaattatatctcaataaaacgattataaaaaaagaataaacagggattttttttttttttgagacagagttttgctcttgttgcccaggctggagtgcaatggcacgatcttggctcaccgcaacctccacctctcaggttcaagcaattcttctgcctcagcctcccgagtagctgggattacaggcatgcacctccatgcctggctaattttgtatttttaatagagatggggtttttccatgttggccagactggtctcagactcccaggcttaggtgagcctctcgcctcgctctcccaaagtgctgggattacaggcgtgagccactgcgcctggcctaacagggaaatatttttcaagttaaagcaaaaaaacaaggtaagccaagtaaaactatataaaaatatatgattttggtgtttacagcgcattgggtaaaaaatcttactcagaaacagtatgtaaaatatttcatttttagaaaactatacattaaatcaatggagagtggccaaaaaattttaacactgtttatctcaaggagctacaactatggtaaatattttccttaataatgaaatgtggaaacatttctgagaacagaaataagacgaagatgtccattatcatcacttgtattcaatactttcctggtattcctaacaagagtaataaggcaaaaaagttgaaataaaaatactaagattggacctaagatacaaaactatgtatgtatattaacaactcaaaagaatccagagacaagttattagaattagtgagtttagcatgactgaataaatggtcaaaataggaaaaccaattttatttctgtataccagcaagagttagaaaataaaacattttaaaacaataccatttatggtagcataaaaattcaaatgtctggggaaaaatttaatgaaagatgtccatgacactttaaatattatttagagaaatgagagaagaggtaaataaacagaagtacataccatgtgaactgattagatgacccagtattttaaagatgtcaattctcccctgaattgacttataaactcaatgcaaccccgggcgcagtggctcacgcctgtaatcccagcactttgggaggctgaggcgggcagatcacgaggtcaggagatcgagaccatcctggttaacacggtgaaaccctgtctctactaaaaaaaaaaaaaaaaaaaaaaatacaaaaaattagccgggcgtggtggcgggcgcctgtagtcccagctactcgggaggctgaggcaggagaatggcatgaacccgggaggcggagcttgcagtgagccaagatcaggccactgcactccagcctgggcgacagagcaagactctgtctcaaaaaaaaaaaaaaaagaaatggaaaaagaaaaaaatctcaatgcaatcccaatcaaaatcacaacaggcttcatatatatatatatatatatatatatgtgtgtgtgtgtgtgtgtgtgtgtgtgtgtgtgtgtgtgtgtgtgagagagagagagagagagagagaagttgcatggttaggtggtaaaagcagtgtttgccataaaaatcaggtcgttggttattttggtggggagggagaggtagtgtttggaaggggacacaagggaaggttttgggacgcatggtataccggttgtcaatgtatggcctcgcacctccaaatccatcctttaatacctgctctgtgggcacagccagaatccccttccgcggctcccctcgcggcagggaggatgctgaacagtagagggcgctggagacacgctgcgggaggctgtcgctcgggtccggctgcgggccacaggccgcggatcgcgctctgccagcgccccacgcccgcaagcgcggcccctccgccacctcgcggcccggcctgacctgttaatcacgtccccacggctctcctagcggggacaccgccgtctgcaggctccgtccccacagtgcccagaccccgggaagtttgtcagtcagcaccctgatgccagccgattctcaaaaagccaggaggatccaagcagatgatttgccagacggtactgcagcaatggagatgaacagataattcacacagaaagaaggacggtagggagagacgtgcggggggtagggagggcggaaggaaggtctaggggaaggagcggagggggaagggaggaaggaaggcagcaatggaatgaaaggagaagggaggaaggactcgttgaatgcacagcctccccggtgctgcaccgacaggagcggctctcacaggcatggggcccccaacagaccctaccaggctgcgggaatgttgcggccctgcagggcgtctctgtcttttttgaggtgtctctggtaatatgtgataatgacagtatttttagacatttggaatctgatttaaattttagctccatcaccttctagctgtgggaccctgagaaacagcacatcctcccggatcctcccatctctcttgtccacacgtggggaaggctcctggtgggggggggttgggggggaggggggaagggggggttggggggagggggaaggggggggccttgcagatttaccaagctgatgtacaaagacctactacagcggtaagggctagctcctttctcccactctggcagtcactccactttgagaaacatacatcttgaaataaagctacaagtggagaggggcaggtgatttgggcaaatgattccatactaaatgttaggacaaaacatcctaggcaaatatcacaatccggcgtcatagtggcatactaaattcaaccaagaaatatacccatgatgttgaaagagccaggcttatggaatgtaaacagcaaactattttattcttgttttctatttaccaattcaaacttactctgcaggtcactcctccctgcccctgggataaaatctagggcatgttctgtgactttctggatcacaaaattcacatgatttttggatcattctcagttaaccaaaaatgtgtcctgtaacttctagctataaaaataggctctgttcagcatttaaaatgtccaatcccatgtaggagtctaaactttcgatttcattttaagtttaagcttcctcttgattcctcccccaagtctggcccaggcttgcatttggctccaggcattgggcgggtagcagtgtttcctctccatttttcactttcactcttccctccccaactagcttgcagggatttctgatcacctagtagagtctagaggcgtaagggaaggaggtcaccaaggggcaggccaggctttatgtgaatagtgctgttgtgagccaagtacttgagtacttcgaggtccccttctactgcagacatcttccctatggttcctgtgacccaggtttgtctcagagtggggttagcacacggtaccatctccatcccctttaaaagtatttattacatttttctggaaatggaagtctgggaattatatttccctgatagtcttatgagcaggattccaggttgattctgccaaatgtgaggcactcaggtgagactagaaagcagaaagatggtttaaaaaatcatcgttttcttcctttgactctgcacttatgacagcaggatgctcgagactcttgcagtaatttgggcaaagatttccacagtgcaaaatagaaaaaacgtaactggcaaatagctgtacaaattacagtccattttcatcatggaatgtcagtttggcaacaatggcatcgaggcccaaaagcagctctgcagtaggggggttcctccttggtgactggatgggcacagcgaagcacaaattcctgaagatcccagctccaggaaacatcagcatggttcattgcgttgtccacctgaattcttcacccctccctgtggctgtgtccattgccctgtagtgttgcagttcccctcaggaaaaagatatcatttacttctctgacccttgatttggagcttggctatgtgacgtgctttggccaatgggatattggatgacataacataaggagagacacagatatgcatctgcacaatgcagcttgcctttttatgcttctgccttcaccatgaaaagagctttccctgggggtagcagctgtccctgcagcctgtgttcagaatgcacaaatgtgaggagccaagcccagccagcttgaaagtgagttgccaggcccagcgcagtggctcacacctgtaatcccagcactttgggaggccgagacaggcagatcacctgaggtccggagttcgagacgagcctgaccaacatggagaaacccccgtttctactaaaaaatacaaaattaggcctggcgcagtggctcacgcctgtaatctcagcactttgggaggccgaggcaggcggattacctgaggtcgggagttcgagatcagcctggccaacatggagaaaccccgtttctactaaaaatacaaaagtagccgggcgtggtggcacatgcctgtaatcccagctacttgggaggctgaggcaggagaatcgcttgaacctgggaggcagaggttgcggtgagccgagatcacgccattgcactccagcctgggcaacaagagcaaaactccgttgaaagaaagaaaggaaagaaaggaaggaaggcagacaaaattagccgggcgtggtagcgcatgcctgtaatcccagctactcaggagactgaggcaggagaatcacttgaacctgggaggcggaggttgcagtgagctgagatggcgccactgcactccagcctgggcaacaagagtgaaaccctaaaaaaaaaaaaaaaagtgagttgcctaccctagctcagaccacctccagccaacccacagatgtgttagaaatgagtgcttatttaagtatggcattgacatgttgtgattagttgttatgcaccattatagcaaaaaaattgcacactgataaaagtaactgttccctcgttggcttcaccagctttcccaagaattgtttaatcccattccctgtataaaatcactctctgctgagaatcctttttctgagaaaagaattctgagaattttttttctgcttgaggcagaccaacactcattccaagaacaactggaaaggctgaataaaacacagaaaacttttttaaaaagtttttggaaagcttcccagttaacaaacatttgaagggtcataatctcaaaagaagaaaaacacaaggaggcaagctggccctctgtgaactacttttcccttcaggaaacgtgctgattttagctaagaggccgagcatttgggcagacggccatagctaagaggcagcaaaggcagcagagtcgtcttcagctggagagacaagaaatggagactgaggttgtcaaggcagctggaactgaaggggccgagatatcatgtagaagggagacacagaaaaggaacactttccccttgaggcatctgctgagttaagctatgcagaaaggctatgaaaagcagcaggttttggcagtgtcatattaatgagataaaagttggagttcaggacccaccaaggaaaagaagcctaataatcacatcagacactcagttggaatccttggaggaccacactctagatagacgggcaaaccagagatggagatgaagccttccaaaaactgcaacatagactctagtcagttcggtaccattggattaaggtaaaatcttcccactctgtctatcagatgacatggtaaaccctcccttgagacagacattgttttcagatcatgtttcctggagccactaaaatttattataatggttagcattcaacaataagtgatcaaacacaccacaaaacaggaaggaggggaaaacagacacaacaaaacggagccactaatgacccagatattggtgttatcagacacagacttgatgggtggaatagagactttcatcaaagaactggaatctataagaaagaatgaaatggaaatttaaaacttaaaaatacaataattgaaattaactacttagcatatgggttaactacaattagatttagcagaaggaacattctttgaactgtaatataggacagaataaaaactctaagctgaagaacagagacaaagagtatggaaaatacagcaaagaacataagatacttgtgggaggtggtgaacaggcctaacacatatgtaactggagtcttagaagggaggaagatggggcagaaggaacagttaaataaatatagcctgagaactttccaaaactgataaagctttatgatccccaagcaggataaataaaaacaaaactgcatccaggcacactatactttttttttattattattttttgagacggagtttttctttgtcacccaggctggagtacggtggcgcgcgatctcagctcactgcaacctccgcctccccaaggtcaagcgattctcctgcctcagtctcccgaatagctgggattacaggcacgcgccaccatgcctggctaatttttggattttttagtggagacggggtttcaccatgttggccaggttggtctcaaacttctgacctcaggtgatccactggccttggcctcccaaactgctgggattataggcgtgagccaccgcacccaacccaggcacactatacttaaactgctgcaaatgaaagacaaggaaaaaacagtaaaagcagctagaggcaggtaggagggacacatttcttcttttcttttttcttttcccctccctccctctctcctccttcctgcctccctcctgtcattttcttttgtagaggggggggatcttgctctgttgcctgggctggttttgaactcctgggctcaagggtgctgggatgacgggcgtgagccagtgcatgttactgacacattactctcaaaggagaaacaatagcactgaaaatcacttgtcaacagaaatgatggaagtgagaagataatggagtgccattctgaagttcctcaaagaaaaaagtgtcaacctgtaatcctatattcacaaaatatacttaaaaatgaatttgaaatagatgtttctattcaaaaactgagaaaggctgggtgaggtggcctgtaatcccagtcctttgggaggtcaaagcaggcagactgtttgagctctggagtttgagaccagcctgagcaacatggtgaaatcccttctctacaaaaaatacaaaagaattagccaggtatggtggtgcctgcctgtagtcccgctactcgggaggctgaggtgggaggactgcttgaacctaggaggttgaggctacagtgaaccatgatcatgccactgcactccagcctgggcgacagagtgagaccctgtctcaaaaacaagcaaacaaaaaaacacaaaaaaacctgagaaaatttgctgccagcagatgtgcatacacaaaaaatactaaagggaattcttcaggtagaagaaaactgatctatgatagaatcacagaaatgcaggaaataataaaaaaaaacagagtgaatatgtgggtgaatacaaatgaatattgactgcacatagcaataataataatgtctcgttaggtgtaaaatatatgtgaaattaaaatgagtaataataatatacatgcaagagtagaatggaggtaaatagagattgagtattgtgagatcatagcattgtctgggaaacaataaaaagtaaaatttgtattagattataataatgtacagaagttgtaatctgtggaggaaaccactaaagaaattataaaagaatgtgtaagtagaaccaatggtagggggggaaacggaattaaaaaaataatcagaaagaaagcaacagaaaagaaaaaataaaaacaaaaatgggtaagacaaatggaaacaagtagtaagatggtatttatgaacacaactatatcagtaattacaataaatgtaaattcacgaaatacacaaaagacaaaatttgacagacttgattaaaacaactctattcaagagacatgacatcattataagaacattgaaaattcaaaaataagggggaaagtgaaaaaaataccattgtgagtggtagagaaagccatttcacataataaaggttcactctaccagaaaacgtcaattttaaatgggtatgagcctaataacacaacctctaaatgcataaaacaaaaactaacaaaactcaaaggagaaataaacaaattcataataacagtggcaggctttatcctctctcagtaatttatagaaaaacagacaaaaatatcagtaaagatgtagataatttgaccaacctgattaacaaacttgacccagttgaaatacacataacacctgcacacaactgcagaatgcacattctttcaagtgcaagaacattatgataagaatattataggaaagtctgtcataaacatagcttatataaaaatataacagcaaattaatctaaattttatttatttatttacttattttatttttttgtttatacttatgtcataaacatagtttatataaaaatataacagcaaattgatctaaattttatttatttatttatttacttattttatttttggagacagagtctcgctttgttatccaagctgtagtgcagtggcgtgaacatgactcacttcagccttaacctcccgggctcacgcaatactcctgccccagccctccaagtagctgggacaacaggcatgtgacaccatacctggctaatttttgtggtttttgtagagaccgagtttcaccacgttggtctcaaattcctgagcttagacaatctacctgccttggccttccaaagtgcggggataatagatgtgagccactgagctcgacttaaatctaaattttattttattttattttatggccatgctccctctaataaatctaaattttaaataaataagtccaagtattgttgtgtttatgtgtataaacctgcgcacacacacaaaagtgtacacaccctgctggtttctattacaagaatgttaagtttggtttgacattcaacagtcaattagtataagtcatcacatccaaagaataaaggagaaaaataaaattatttcaaaaggtgcagagtaagtatttgagagaaatttaaccttatttgtaattaaaaaaatctttttaacagcttgagaatatatgttaatgagtacattaaaaatcctataacaaccatcaaacttcatggtgaatattgacaactctccacatgccacacccaccacccctgagattgaggatgagacaagaatacccactatcactacttatagtcagcattctgctggaggtcctagccactgcaatttgtataccaattttatatcttgcaaccttgccaaacttattagctctagtagtttttttgtgtgtggattccttaggattttccatagacaagattatgtcatgtgcagatatagttttacttctttctttatgatctggatcacttttatttctttatcttgtccaattgctcagccactgcagtttggcaagagctaaataaggcataaagattaagaaaggaagaaataaaactgtcattcacagaggacatgattatacaaaaataatctgcaaattattacaatttaaatgaatgtcacaaagcctctcactggataacaaggtcaacatagttttgtagcaacagaatctgtatatactagccataaacaaatataaaacgtctaagaataaatctattgaaggatgtgcaagaacactttactgaaaaccacaaaaatagttctgagaaacatacaaaagacttaaagtgaagagatataccatgttaatgaataggaagattgaatattttaatgatgtcaaatggcccccaaattgttctacataatcaattaaatccaatcaaattctagcactttattttgtggaaattgactagctgattctaaagtgttttatggaaatgtaaagggcttctttcttctggagttgccttgtggacaggatttgagacaacccaggccaggtttctctggtccatgggaagcatgcgtatgctttttgccctgactatgtctgtagagaacagcccaaacaacaacctcctccccatcagagcagagagccagctagtctcttgccatttagatttttcagggatgagtcagagataccagtctactctgtcctgcagaaaaggatacttatcaacttttccaagcggccctagaaaagtcactgctagtcagaaatctcaccttggaatgtgggggtggctggcatctatccggatgtcagatgaaacagaaacagttccactgtagtagcctgctctataaacacacagagaacccctattacatgtgagctatgaagctattagaaactacagctttgcggactactttgaaaatgtgcaagtgggccgggcgtggtggctcacgcctgtaatcccagcactttgggaggccgaggcgggtagatcatgaggtcaggagatcgagaccatcctggctaacacagtgaaaccccgtctctacttgaaaatacaaaaaattagcagggcgtggtggcaggtgtctgtagtcccagctactccggaggctgaggcaggacagtggtgtaagtaaacccgggaggcggagcttgcagtaagcctagatcgcgccaccgcactccagcctgggcgacagagcaagactccatctcaaaaaacaaacaaacaaacaaacaaacaaacaaaaaatgtgcaagtgaaataagtgacaaaaagcaaacacaagatattctgttcatacgaaacactgcgaggcgacacttgtgtttgtagattgacagaaattggaggtggagttaaagaggtagaaactcagtataacattcattgcctcttttgctaaagttgtttcactgcataagaaaaagatactggtcgggctgggtgcggtgactcatgcctgtaatcccagcactttgggaggctgaggcaggtggatcacctgaggccaggaatttgagaccagcctagccaacatggtaaaattccgtctctactaaaaataaaaaaaattagccaggcatggtggcgggcgccagtaatcccagctacttgggaggctgaggcaggagaatcgcttgaacctgggaggtggagggtgcagtgagccgagatcacgccattgcactccagcctgggtgacaagagggaaactccgtctcaaaaaattaaaataaaaaaaaaaaaaagaaaaagaaggaaaaaagagaaagagatagtggttccatgtgctgttctagttacacaaaacaacgtgttgacgtgcaggctgcacgatgccaggtgcaaatacacactacctgttacagtaactgtgacaagcacaagggctgctcactagcttgagtgcaacttctggggagttgatggcagtgatctgtgggtacttccttcttaacaaattttacatcaatactgcaacacagcaatctcagccctgtgggctataccatagccacatgctttcaccatttcctgctcaaagggagagcccaggaactgaatgctcttaatcagggagagcacagaaacagcagcagaacagctggagaaccagggctgtgtggttttggactgtggggagggtgggccatgggcagacttgacacaatgtgggagggcatttgacacagccccgtggaggacctaatgctcggggaggccttcacccagcacagtgagccatgccgacacttggtgcctgagtgcgctggtcacagcgccctccctgtgattttccccatagcagtgtgttttctctgccaggcagaaggcagagaaaccctggctgaaaaagcagtgagggtcatcgactgcatgaacacatcatcagctttcccagatggaggcacccaagtttaccctgcaggtccattcagcaggtagagctgggtcatcactaaacaggatctttcttctgagcatctgagattctggtccaaatcagggctgtgaggaccaggagccgggattccgagcccaggcagccccgcagataaggaggagggagtgtgtcggaaggctgtatggccagagccgctgaccgggccagggcttctttgtcccctcttctctcctgcatatcagcactcacgtcctcctggctcgggctggctggcagctcggggagctgttggatgaaacgtccatgcgtgtggctgtggctgtcacatgcaactgcgaggatggtcggctcccaaagcggaaccgcggtgctgggcgaagggtcagggctccgtggtgcggcagagcgcatgccagcgcttcaccagctccttgggcttgctgagcatctcgtcccagtgctccagctctctgccgcgggtgtacatgtaggggcccaccaccactcggcccagctgctggctctctgcaggggagggagagcaccggtgtgctcctgagcacagaagccccgtccccagtgacctcctttcctccctcctcctccccaggaggaagtagcaactcccctcctctctgagtgggagctgacaggccccaaaggggccctgcctttgctctgcagctggaagggctgcttctccccctgggagattgggaggaaggagagccctgaaagactctctccttgagggccaccagctctgccccacacccttctgtggggccgtattaagtctaccttatgccaaagagctgagggaggaaagggcccctctagaaagaaggcctcggccatccgagagtacattcagcagtaacattcactggccaccgtggagaagggtcttaagtccaggccatgtggccagccacggcctgatggctctgtttccccagagtggcagtgggtgctggggtgtggggcagtgtgggagctggctgacagaactcgcccagaaccccaaagtctcatctggagggcacgaggaaggtcagagcaccaggtccctgggctggtggcaggcctggcccctcccactctctcgggtgatttgctccaggagagggcagcagaggccattgcttaacctctttctttttcttttcttttcttttttttttttttgacagagtctcgctctgtggacaggctggagtgcagttgcaagatcttggctcactgcaacctctgcctcccgggttcaagtgattcttctgcttcagcctcccgagtagttgggcctacaggcgtgcaccaccacgcctagctaacttttgtatttttagtacagacggaattttactatgttggccaggatggtcttgatctcttgacgtcgtgatccacccctctcggtctcccaaagtgctaggattataggcgtgagccaccgcacccagccaacctctttttttttttttgagacgaagtctcgctctgttgcccaggctggaatgcagtggtgcgatctcggctcactgcaagctccgcctcccaggctcatgccattctcctgcctcagcctcccaagtagctgggactacaggcaccagccaccacacccagctaattttttgtatttttagtagagacgtggtttcactgtgttagccaggacggtctcgatctcctgacctcgtgatctgcctacctcggccttccaaagtgctgggattacaggtgtgagccaccgtgcccggcccttttttttttttttttttttttgacagattcagcagcctcgcctcctgggttcaagagatcctcccacctcaacctcccaagtagctgggattacaggggtgtgccaccacgcccagctaattattgtatttttagtagagatgagcgtttcaccatgttggccaggctggtcttgaactcctgagctcaagtgatccacccaccttggcctcccaaggtgctgggattacagatgtgagccagcatgcccggctgcttaacctgtttctagggtgccacagacagagctcaactggactaaagctgggcctgaaacccaggccttgggcaatatttcagcctttctgagcactagtttccttaaccagggagggagctcgtacagctccttctgaggtcaggacaggaggcactcactctgcctgaacactcggcagcccctcgtggtccccatcccagcagcccagggtagggtgtggccttactgtccccttccatgttctgcaccacagtcaggctgaggctagcggtatccagctcggtggcatcggccttgaagctgaaggtctcattgtacacagggttgatggagcccagcacagctgaagtcttcttgcacttgacaaacttgttgtggttcatcagagacactttgacaaacacacctagggaacggtgagcactagtgggctggcagaggcaggtgggagcagagcccctgcctgtgggaggtccggctaggagggcacgtgcccaagctaggtgccagggccccacccctcacacagtgctgcggccccgccggcgtgaccagaggaagccggctgaggagtgcactgccctgcggcccaggcggggctccgctcccttccttttccttcctctttgcatcaggaaagtacccacggctcctgcaggccctggtttaccagagcctagcaccgcaagcctgtccctccctgttggggggctgctcactgggcccccaggccccctggggccccttaaacaccttgtacagagggctaagatttggtgggtgagggtcagagtcacagtggaaggtctggatcctgcctggcttacggtgaccccagatgtgaacacaaacaggtggctgaccaccacctcactgggatgggtgggatgtgtggggtgagcccaaatggggtgggacatgtggggtgaaccaaggcctccccttctgcagctcctgtattctgggaggccaagcatcagtgcccattgagtcgggggctcttcccctgtggggagggaggtgcgggcctcaccctggaggaactggacccatgccgctgatggaaaggtggaggtggaggcaggcaggacagttcaaagagccaagacgctgcctcgggaaacaggaggggcagggcctggtattgcggctgggttagaaccctccgtaggggaggccaaggagatgcagctttgggttcaacacaggaagaggcttcctgcaccagaactgtcgaccgagggacagcacgtcttgtgaggtagtgagcgctccatgataggtgtatgcaagcagaaactggatggtcagggatgaggttggactgtagccccaggctgtaagctcggtgggtgggaccttccccaggaggaaagggaggaactcactgacaatgcctctgtcctcctggagccggaggcccttggcacgcagcacaaccaccgtcaggcggctcaggtagtcgttgtagctgaggcagaactggaggtcgccaaactccgaggggggctggggaggccaagatggaagcaccccaccctgttactctggcaagtgctgaaggggtcacagaacccccagagagcctcccgcttcctcctagcggtccatgcgacacacccgcatggtcccctttgagttccactgccattttaaggatggggcaactgtggtctggagagtttaaggggcttgtgcagtcctgtggaccagagctaaggagtcacacccaggtctgagccagctggggccttcctgggggtggtgggctggaggaaacatttccctgggctggaccatttgtggtgtcatctctcacagctgtctaacctagataagaatccaaatgtggatatttcaggttgctccagggggtctgatggccagtgtgacaacaggacctcaagcaggccctccctgcccaggggcaggtccgttcccacctgtcccatgctgcttggggcctgggccctcctccctgagtcactgttgtagggtggtgtgcaggatgctgagggctgatgccgccagcaggtgctgggccctgtgcacacctgccagctgatgctcagtggcataggcatggtgaccttgaccatacctccaggctctcggcctccaggtctctccagatgacacgccggcagtcccccactagggtctcattcttcaaggggaagagcacctggcccaggagctggtgcttcctctgcctgtccacgtggtagacggagaacttcagcaccctctgggtgatggtcttgctggacacctgggggggacaaggacaccagccagagtcaggcgtgggggtaggggatgggatggtgtgacttgttattctggacatgggtgcttttgggaacgggtgtctcaaccagggacccacatcccccaaacctaggcattttcaggggacccttctcagcagcagagccgtgtacccctggaaagtgggggtaggtgccaggaccttggtacacagagtgtggtccgaggacctgtagcgtctaccaccacttggagccctgttagaaatgcaggatcttgggccccagcccagattcatgaattggaatctgccgtttaaccggagcaccaagtgacatggctgcacggtgagtgtggctccgccaccaccctgcactgtagcaaaggcccaggagcccagggcaccggcctgtctctgctgtcagagctgggcatgccagctctctcctccctgagatttggcctcctcgcctgtgaaatggggattatgggtcttcctctctggttgtaaaaccccaatcacagtgtctgacctccagcagatggcccattaatattgattttcttttctttccccttctcccttttccacagagggattggatcaagctggggcgagatagagtggggaagtgatgagctaagaaaaattagcctgcaagcatgacgtgtcgcacgtcagcaaggctgcagccttggattctgatgtcttgagaagagcgattcacctgtgaattctcacagccctggcctcagaaagacggcccgggaccaggcccgatggcacccctcttcccagctctcagccagggcggaaggcacaagtgatggccctggcctccgcagtcacactcctcctgaaagctgactggctgaacctcacctcttggctagcttgccacccagctcttgagaacatgtttgtccaaggcctcttggcaggtctcgatgactccttcccctaagggcccccagtcacctgctaaggctcccaggcccctgtgaaactggctcggtgccccaatagactctccacctccagaccctaagccggccagcccagagtgcagcaaggcaccacacctaccctgtgagggcactcgggccccgcgctggcctctgacagcacaggaagcttctgcattcacgctgaggcctgtcttttgccttccttagataaacttgccagaaaccccatagtgcttcaggcctttgggataattcccctgagccccataggccagggcctggcattcagtagttgctctaaaattgtgttttcacccactctcttccaggtagtcaggacagggaagcccaggcttctggtcaccactcaccaaatctctcccctgcccctctatcagggatcagctcctataggccttaacctagcagactaggtaaagcagagctggtggcatcaagggtcccgggggctgcagagccctggctggtacaggaggctgggctctcctgtaggtctgcaccttcccagcaacgcggagggcaccagaccctgcctgctccagaggctgtacctgaaagatgaagtgctcgtcaaactgcgggttggaggttttgcgtttggtcttggattggaggaagcgccgctcatcgggcagcaggtagagcttcaccagggggctgcaggtctccgagggggcttgcaggtgctgtgccttgatcaagcccaccagcagccgctcagcctcctgctcatattccaccgagaaccacagccgccccaggcagccgtcggggaagtcggtctcacttttgtcctccgggaacttgtacagctctgggttgatggcccccaccatacatgcatctcctatgacagagggtgggagggctggcaggccagaggaaggcaggggcatgggagacagtggcaagctctgggcacccatccccatcctggcccatccgtctctgctgagcctcagctagcctgaccacatctgccccactctcctcaccaggctaaacacatcccctctctctggtgcagctcctccaagaagccttctcaccatgaaggcattgcatggccaggctggggatccagcagagtcctgccccctgggattggcccccatccttggaggtcaggacctgtttcaaggacacagtgcccatcacctggcctagcccccttccatggcgtctagggaatgactcagcgataaaacattgcctttcttcttcctcttcaaattagaagggccaaggtgattattgggtggttcctgtgatggtctcttggtagatcttcagggcaaagaggtggcagaaagctgtgtttgcagcccctaccattctgtcctcttggtcaaccaacccatcatcctagagtgggacccagcacaagttctgtacatggcgtgcctgggttccaattccaatctgttgcttacagcctcagttaagactatgtaaaatggggtgataattcctccccctcagagtcatggtgaggtctcactccaaatcagcacccaaggccatatcttaccctcatggggtgcagcaagcacttcataaatgaaagcacccagaaagagtggtccctgggtggtccctggcatccctggctggttcaggttgtgttccggagccaagctggtgaaagcagatggggccacccgagcagaccctgacctctgggcagccctggcaaggacactcaccaaggccgccgctggaggtgtgaggcagcagctctgatgccgggcaggggtcccatggggcatcggcccactctccactgtgcaggggcacccaatctcggccttgaagggttgggggcaccacgaatggcacagctggtggcctgtccagagtcagggagacaacatgtaggtggcaagtcaatggtgtggtctcagagcgctcagccaggacggttgagcaccaggggctggaggaagaaaagccatcgggagccaggaggaggccagggcaccattttctgggcccataccaggcaacacacacacacacacacgcacacacacacacacacacacacacacacacacacacagcagtgggatttgaagaaggaacacagcacctgacagtgtcagccagtctgggtttggattcctgttctgccacttactaattgtgttctctggacctgttgcttatgtgcactgagcctcagattcctcacctggaacatgggtttcataacacctgcctaatagctgatgtgaggtttctggggtttctttgtgatagctcccagcaccgaagcagcatagaagaggcacccccataaacagaactttccttttcgaccccaccctgagggaaattccaggggcgcacttggccccacatcctgcctcacctgctcagttgggtcctagcatgcggctggcagggcctgtcccgctgcccactggaggcagctgtggtggccatggctggtgtcccaggcagctcctcataggtgagggtggcacagaaccttctccacagacagcagcttgccccgatcaacagcagcagcagcagccccccgatggtgcccccaatcaccagggccagctgctctgggggcagagaccaccagtactatgatgcctgcctgggaaagccactctccctcacagccctggcctgctggggcagaactagggcagcaaccctgcctctgggtttgatctcaggagtgataggagcaggcctgctggggatgggttccgggagggatgctgctggctaggttccgccagctctcagaggagaagccgtttaccccagggtctgagagccctgggcagaaccttctagttttccttggaaaacagctggccctgcccttgggattctggcttaaagaagccatttccttgcgcttctgagtagaaatcaaacctgccctcaccagaacctccatatcccctgggctcctgttgaggccaggaggggagctggggtgtggacgcagtcagttaaggaaagccctgaaaggtaccttccccctggtctgcaatcaaacctctaccctctggggccctggaacctgctgcaaggctggactcttctctaacacccgctccctcccctagccctctatcaaggtgagcacgcgcttaggggagttggtgcgacgcggtggacgaggtggggaggaaaagggggcaagaccccgttgctgctggccctcacacgtccgcatttgcgggacctaggaggcttcgccccgggggtgctcagacgctgggttccaaccgctggccacctggggcgggccaaaaaggtgcctcccttagggtgacgtgcggccgcggggcattcaggtctcagggatctgcactgggtggggtggtgagaaggccggaccccccacacctcctaagccgcaactgaccgcgaagagcgggcctcagcgtctactccatcccagtgcccctccaagagcgcgccgaggccgggcagggcaggcgctgcaccccagcgggggcggcggggcggaggcaagtgctggaagggtcgcagaggggccggggctgggctggggaggcgaggctcgcttacccgccatggggctgctcccgcaggctggtctcgccggtctgggcggctggggctgggctgccaggccgtctcttaaagcgccgcggggcgccgtcgggcgagcacaggggcggtccgtggtgctgctggtgcccagctgcggcgcggggagccgcgcagtgcacggcaggggcagggacccagcgccccgaggccgcagtcccgccccagcccgtccctggcccaggcccaggcccggcggtggaggggcgcagagccgaccgtgagctcccggaaaccgcagggctccagccagggcgggtcccgggcgccaggggcgccaggggctccctgcggcttggggcagggtggggtgagagtaccacccccatcccggagagcagggctacagccttcaccgccgcgtctgacacagggctccgcacccgacccctcacacctggtggccaggactgagcccccgccctcccagatcctcctcaagccgaggcccctccagccgcagctccgaccccggctcgggggagccttcccggatcccggggtggagtctccgcgcgggtccccggccccagcgctgcctgcctgatggccttgggcagggatgcggcgctcgcgcacccgttcgctctcagcggacaaaccggtcgagagcgcaattctggagcgggttccagaagctcctgggttccaattcaggctcctcactcgccagccctgcgatttgggacaacttaacgttcgtaagctgggttcagtcttctcaattgggttaatgtccgtgaggggctctcgtaagggcggctggcctgccggtaacttaagaagcatgtaaagagcacttagagcggaggagcggcgcggcccagcccctgttacggtggttatcggatggaggccagcgtcgcctgggtcccctctgtacacccagcgcctattattatggtgattattagaacgcagggcccgtgcccactagtccaggctggcgaacgcgccttgcgggaaaggcgggagtaaggtcgctgcgtgtcctctctggtcacacctcggcgcgccctggtcgcgcccctatggttcccccgccgaggcctcgaggcgtctgagtggggagcgaaaggaatgtgtgtatctgtggtgcaggggagtgtgtgtgtgtggggggggggagggggtggttgtgggggagtgcgtgttttggggggatggaccttctcgttttacagccttgaaggttatgtccagagtcatagcctgggtcccacacccccgcgtcacctgtgcctgtcctagggggcagtcagtgtgcgtgaggctccaccctgcctgggctttggctcacctaaggcgaggagggtggtgaactggggtgccccactgggccgggtctgggagccctcagcgccagggtgcagaggccgcagccactccccttctagggtctgggcggtgggggcatgagaaggcggagacccaggccacttcacccagtaactgtcctcagctgtgcgcttaactggcgagatctccgctctacttggagacagtctggggtgtctggagaatcctcccccacttctgcttaccccaggtcgctgtgggagcaggtgtctcaggaaatggggcctgggtcccacccaaggcctcgggtctgagttagatgtctgtatgtttgttgttgcccctgcaacaaagtaccacagattgagtagtttaagccacatgcatgttatctcacagttcggggggtcgggaatctaaactgggttggcagggcctgtgccttctggaggcaagggagctgtttcccagcgtttccagctcctagaggctgctagctagtggccctttcctttgtcttcaaagccggcagcacagccttttctaacctctcccactccaggtcatttcacatcaactctttctgcctccctcttgtaagtgtgataccctaccttgttttaacctgaattgactgtcccttagctgagagagccagacacactccattttggctccttcacttgcagccccttacccaccccccttcctcaaggacttaacttgtgcaagctgactcccagcacatcaaagaatgcaattaatggataagatactgtggcaagctatatccgcagttcccaggaatttgcccagttgatagtaccctaagcccccacatttgtgtccggttgatggtacccaaagcccccgcatctatcgccttgtgatggatttaaaacccctgcacctggaactgtttgttttcctgtaaccatttgtcttttaactttttgcctgttttgcttctgtaagagtgcttcagctaggctcctcctcccctttctaaaccaaagtataaaagaaaatctagccctttcttcagggccgagagaattttgagcactagccgtctctcggttgccggctaataaaggacttctgaattcatctcagagtgtggcgtttctctataagaggctcatcagataatccaggataaccaccacccccatctcaagatcattaacttaatcacacctgcaaagccccttttgctatgtagtcacggggttggggatgaggacttgatatctctaggaccattgtgtggaccatgttgtccatgcagtaccctgggaggggtggcttacatttccccttcctctgtctagagttcagtgtgcctcaacactggactcaggcagctagcaaggctcaggggacccctacatggaacccgtcagctatcttgaccccttcccccagctgccatgcacccccacctgaccaccccaatggggcatggcatccacaccagctgcctccatgattgcgcccgagctgtactcaggctgttctgggggtggagttgggtagtgggatgttttttgaaaagggaatcccttctggcacttcctgagtgccaggcccagagctgccatctctcgacccccatgctgtgcttttccaaagtccccatctttctctgtgtcaccaagtcctgacagctgttcctcctctgtccatctctatcatggcaaaaaaccttgcccagccctccatcacctctcatctggagctctgcatgggcctcctctcagctcttcagattccatgctgcacccactccccttcccagctgttgtcttccaggctcccctcccattctcatcccccccaccacccatctctatgcagtgcttgtgcccagactgatgcagctacttccacggctctgcgtatgcactgggctctcccaccatgctgctctctccctgtctgaaatactcaatgcccctcccaccctccttctccactgctcatgtttcaagatgaacccccagcatcttgccttctgtgaaacccttcatcatcccctccttgtcctcatggtccttgcagctaccatgccgaatatgggactctgtgcctgagactgctgcctcactcttcctggcagccgagggcctccatgaaggcagggggccgtgtcttattcagcttggcatcgccactatccacctccagggctgaggctgtgctgaatggcagatgaagggctcttgccattgggatgagctgccccagcttctgcccacattgtccatgcatcatacacatcctgggctcacaatttagggcccaacaggagctccctgccctggtcctgcagaccagcttctggggtctgcaaaatcacgttgtcagctctatctgcaaaatccttacactgccagccagcccactgagttttgagtcaatcttcctccacgggaagataaaagcaggtggcaggagggagctcatccttcttgctgctcctgatgttctgagcattgagatgcaggcctgatgtacacgatcccatggagccctgcctcatgtctgccctgcagggtcatgacctcctcctcagatgaggaaactgaatcaaagaggtttcctggcccacccactaagtggtggatctaggcctggcacctggctccctcgttccttcttcaccagtgagcagctgtagggcaaggacccaggagaccctctcctgtggcgctgaccgtgaatcaggcaaagagccacaggcactttgggcagcctcccctccatccactgcccgggggctctgagacctggctggcctggagccagctccccagaacagaaaggcatccagggtctggcagcagctctggctctgcttcctgttttcagaccttgttcttccccgtgtctgtggagctgggaagcctggaaacagcagcagacatgggttctgtctttcatggccaagcggaagttttatttccatggcaaaagcacttccaaggagggctgcaggaagtccaagagtttaaagacctgcaaatgcctgcaggtgattaataattcattgcagcagatgattacgagaaaggccactttcaattaaccttaagaatcatccctgtctaaggaagtgtcatctctcatcactgaggaacacagaggccatagcaggataaaggccacgctgagaagcatgtggaagactgtgtttctcaattcatgcaaattgcaccaggtcagcccaggtccttctttgtgaggagggggagggttcccctgccagcatcctgtctgctctttggttctgctatggcggcctcagacttaatttcctccagccccttcttttgaggagcttggagggagtatctttccttgttggatcagaacttctcgtcccccactgaaacatgctggctccaaattgtgtctcctcctgcagacagtcactccgactggcagggtgggcttgggcctgtggctcgctcctgcccctgggcgtggtttctgcttcctgccctgctgctcccctgcctggcaggcctgctcccctgcctcctctcaaccagcaccagaactctgccttccctctggagggaacaacttccttccccttccctgtccacacagtacctggcactcccctactcacccctattctagcgctttgtccatgacccaggcctggctgctcagcctagttcatttctggctgcagtgataggttcagggatgtccctgtgaccccaccccctgcccccgcgagaggctaatcaggatcaacactggaattttgtgggatgtactggggaagagacacctcctttctggcaggagttgttgagcagaaggagctaagtctggggccatggaaagccccacgtggaggagccagagaggatggagccagcacaggtgctgaggtggggacctatgttgtcctggcagcccctgcatcctgctgcatgcagcccctgcccctggaggggtggagagagagggcggcagaggggagtgagcccgccaaggccactgtgttagcaaggagctgagccggcgttggcatcagctgttccagcttcagtctcttgaccaccaaggctgcccctcagcatggagcagaagtcaggaactgaggcaaggcttgtccttcctcaatcgtcacctctgggcactcagctgtcctaaagttttttgaccccccttagggatggggtcttttcagcaagggccatttgtggcaaacaacaattaatttactgctcagcctccatggctcactcctgcccctccgccagcttctgtgctaacaactgacccacatttttttttttcaggaacagcaatgtgctcagtcaccaggcatgcatccaatgagccataagagggcggaaagactttgttttttgatgtattaatatgctaaattgatgtgtcggttaagacatgaagaaattagctatcaaactccaaagagtggtgacagactaagacgcagatttccaaaggtggctgagaacctgctggacaactgtcccccagtgagaggaagggctgagagagtgagggagggaggggatttgccagattcctttcttgagggctggggctgtgatgtggactcccacctcctacggctggccagggctggggaggggggtgtgctcggggagggggctgtgctcaggtagagagggggcaggtggagcagaggacagcctcccctccagcccagagagttggggattcaactctgctctgagagcttgctttctgtcccctggagtttgggaggcagacggactgctggtggaggtgcacaggcaattgtggcttcttggttctgatgaagacagtaggcagctgctgtgttgggaagcagccaggctccctcagatgccagccaaaggtttgtggatcttgggcacatgacacgccactggtagtgcgagtgtggctcagagtgtgatggggaattgtcactgacatgtgcctggggacttgtcaggatgtggaatgtgtacatatttcccacaaccagacattggccatgtgaatgaaagagccggtgtgtgatcatctcagtcctgaccacaggccctacccagagggcatatgtagcacagtggaaggaagtaggaggtgaactttctaggggtagaggagggagcaagtggcttctgattcatttgctcaggtcaagggcactctggttctggagtgggtgtcaggggtgaaggatcgagggttcctttcaaagggcccatttgagcatgaaacctcttccagatctggagaggtaaggcatcttacgagaccgtcaagacagaactttccaaatccccttcccttcctctgctcatgctcttacctcagaagtctgctacgggcagtgagagaggagagaggaggctgaccatggcaccctctccaagggcagaggctgtctgtggctggccctcaccatgggagatggggagacttaactcaagtttgcagatttgattattacctaggtggcctttctgatgactgtcttgggactgcggggacagtggctagaagggaatgatctctgctgaatacctgctccttccaagtgtggcctccatagggagctcggggctctcacatgtcctcctttgttccctcaaatagatcccaagatcttgaacgagaccattttactgggctttagtgctcaaggctgaggtttcacttccataaaaaaatcagttaaaagtgctgagcctgtgggaaggctgttctttggttaccttctgtggtcaattaaacgattggtctcaagttctctcttccctgtactggtattgtactcccacagccttgcaacatggtgggtgcattagactgtttatattgcttataaaggaattcctgagactgggtaatttataaagaaaagaggtttaattggcttacagttctgcaggctgtaaaggaagcatggtgccagcatctgcttctggtgaggcctcaggaagcttctactcatggcagaaggtggaaggggagcaagtgtgtcaagtggcaagaaagggaacaagaaaagggatgcccacttttttaaactaccagatcttgcctgaactcagagcaataactcactcattactaaaaggaggcaccaagccattcatgagggatctgctcccatgatccaaatacctcccaccaggccccacctgcaacattggaagccacatttcaacatgagatttggaggggaaaaaacttccaaaccatatcagtgggacacatgcttccccatgatttgactttgagcatggccacatgacctgcttgggccactggaaagttggcagagatgatgcggcagaggctggaactgcaccgtgcggctggccttgctctcctgtgctttagccaaggcggtgagatgagcatggcccagggagagctggctccaggccaatgagtgctctgtggtgcaggtccaaaccccacctggagcctgagatcaaggagttcagcctgagccagcagaccccagccaacccacagacatggaagggaaaaataaatgcttctggatgatgccatagagactctgtaagcagcaaaagctgagcaaaacactgtcactctcttttgattcctttggtgagactagagctgtgagctggcagggccacaccccttgtcccctctccacatgcctcaaagttgtggctgaaggtggatgatcttgtcacttttccttactggctggccttggtcttctctggaccagcctctgctgctgtgggaggaataaagtgctaaggggtagtgggtttaggggaaagagagaaggcttgtgggggacatctgaggttttcacacagcatactttatccttcttttgttgcagtggtgccccagtcaaaagtgccctctgggaaagcccttccctcctcttgggtgtggttgactccaccctcttcttcttccagctgggcttgattcctccacaggtccctcctcctggctgcagagattggttcagggaaacacagagccaatgagctgcaaggctgatttttctgacaatgctggacagaggcaagggttcttcccgagggtcttgaatttaatgagagaatctcaaatgatgagaaaaaagctggtctgaggacagggtcagctgaataggtcgtacccagagaaagagagggagagagatactggatgctggtgatgggtgaatgagacaaggcatgaagctagaacaccacctggtttttcacttaggtgagcccacaaattccgatgtgtacttaatgccagcttgagtaggtatctgccatttgcaatcacaagtcttcaatgatacaagattgcccacctgctttgggccgtctgtggcccaaatttgtacctggccttattttagggacatacacctttcttgggtttgcacacacacatgtgtgtttacatttggacatagtagaacaaaataatttatataaggattttgaaatgctgaccaaataaataatctacaccaaatactttacttacgttgttttattcattcattctttttaaaaaattatttattctttacaaccaccatctatggcaggtttttttttttgttgttgttgttgttagatggagtttcgctcttgttgcccgggctggagtgcaatggcacgatctcagctcactgcaacctctgcctcccaggttcaagagattttcttgcctcagcctcctgagtagctgcgattacaggtgcccaccaccatgcctggctaatttttgtatttttagtagagatgtggttttaccatgttggccaggctgatcttgaactcctgacctcaggtgatctgcctgcctcggcctcccaagtgctgggattacaggcataagccaccatgcctggcctatggcaggtacttttatcacttaggaaatcttttggttacaatttacagtaaatctgactaaatctgactaaataagcctaaatagggcttacaccataagaagatttgctttcttatttcattagctctaagatgtcattgattgtgaaatgcaccactgttttgcaccactttctttgtataagcaaaacttgctgccaaaccatgaagccattctttactatcaaatcagatatgagaagtgacagtggtgtcagaatgtgaaaaaaaaaaggccttccttggaatggggagaaatggtgttacttagcaagacatttgtggttgggtagcctcagatttgacttggcagctcaacatcatcatctaagatccaggttccttggatgtgtcacctgctctgccaccttcaagtttcgagatggcttggtgtcttctaacaccaagttcaaaggcaggaaaagaaggaaaggaatctgatagggaaagtgtttatttcctcactcacatccctcatcttatcagaaagcctccggcacactgaccctccataccttgttgctcactggcgagacccacacacagccatgctggtttcaaggagaccaagaaagtgagtatctgaccttttcagtcctataatgggagactggttgaaggaagaggacataagaaatggctgtcaatgccacgggatttcaattccaattttacagatgagaaaactaaagctggaagaggttcggcaactcgcccaaggtcacacaactagaaatcggtcaaccccagatttgaatccagtgtcgaatgattcaaagttcttcccattgcaccataaatcatctgtacatgaaagaccgaagactgagaaacctcaaatacagagcaggtaaatagtaaggaacgtgtttggatgaaataccagaacacctgaccatcagtggatcagataggggtttattgttgttatgtagccagcaccccagagatcagcagcccagggtggcacagatgcttaagggtttcatcaagatcccaggctccctcatcatcctccttcaccttctggagtgtgtggtttctgtccttaagttcacagtatggctgctgcgtctcaaggcatcacatctagctttccaagaaacccctacctagtgattccctcttacatctcattggttagaacaaggtcacgtgtaactaaccccagatacaaggaagttacaaggaaaagtaaatatatttagctagacaattgtcatcccagtcaaaactggtgctctgttttggaagaagaggagagagaaattgggtagtggttgtcattagtgaagtgggtatttggccactatatttggttttctttcttctaggcagatggtacaacccttggggttagttaaggatgtgtaacttactttgatcaatgaaatgggagcagaagtgagatgtatcactttctagtggaagctttaaaagttggtgcataaaaagacacatgcacccatatgttcatcactgcgctattcatggtagcaaagacatggaatcaacccaggtgcccatcaatagtgggttggatagaaagaatgttgtgcatatacatcatggactactacacagccacaaaaagaaggaagacctgtcctttgcagcaatatggatgcagctagaaaccattatcctaagtgacttaacataggaacagaaaactatatactgcatgttctcacttgttaaatgagagctaaacattgggtacacatggtcataaaaatgggaacaacagacactggggaatacaagagaagagagggagggaggggggtcaagagtcgattaaaaactgcctattgtgtactatgctcctcttgagtgatggattcatttgtcctccaaacctcagcctcaaaatatacttttgtaacaacctgcacatgtaccctctgattctgaaataaaagtttaaaaaaagacagttggtacattgttccccaagttcttttccattgatgtgatgactgtaaaagcaaatgccaagagtcctccacgatgaacagagccctcttgccaaacctgtgataggcatagagcaagggtgggaaatagacttgtgtttagttaatccactgctatttttgtgaggtcgctattgcaacataacccagactatcctgacacaggtcggcaatcagcagtgtccacacatagtcctcaagcaaggtcatgatcagaccagggaggagccagggcctaagcctgaactggcataaacagtgccccaatttctccaaagtgaggactgtgccagtgggcctcaagacaagaattgggagtccacagctcccagacactggggaccccctcctatctggagctgcctggctgccacatatgagcctggtgacccagccacacccaccagctagctcatcagcagtgtccatgtcattatcgaggcagagaaatccactcagcgaggatttcccacgttagcccagcatccttacttctcgctcatagtaacagaaaccatgttcccgcctccaacagatgcactgtgctctgcactcccctggtcagcgggtgggtgcatgatgcaaactgggccagtcagatgctttcattctgaaacttgaatcttgagtgaaataagccagactcattggggactgattggaatttactcaccccggtggaggcacatggaagaggcccgttgggtcctgctatctatgtcctcagagcttcacttaccacagttcggagaggacagcacatcctccaggggttctgaacctgaatgcagcaactggttgagaacctgagttctgcgctgtcttctgttgcagtgggagtgagtagggttttggtggtatatggtataactgccttatcttgagaaagaatattttaacagctgtgtttatgtcaagaggggtatgtgtaacattcaacaaccaatgctgcagattgcagaggacatttgttgtttttgcctgctcagcatctattcttgctgcttctggtgacaaaattcagtggtcccatttctcttttaactccagagctagatttgatccagacctggccagtcagagcatcacatgctgcaggcctcagtgagtggttaggagctgggcagtggcctaccttagtttactatgacttgaacctggaatttgtgggcaacttttgggagccataataacagtaatggcagctgggctcacacctgtaatcccagcagtttgggaggccgaggtgggcagatcttttgaggtcaagagtttgagaccagcctggccaacatggtgaaaccctgtctctactaaaaatacaaaaatcagccaggcgtgatggtgggggcctgtaatcccagctactcaggaggctgaggcaggagaatcacttgaacctgggaggcagaggttgcagtgagccgagattgcgccactgcactccagcctgggcaatagagcgagcctcagtctcaaaaacaaaacaaaacaaaacaaaacaaaacagtaatggctagtacagttaacttggcactgtccttgttccttaaactcttgtccatggacttagagctgtgaggacataaacataatccaggagttcccaagacccactatgtagggagagcctggctaaaagagagaggtgccagttctgatgacatcatttaagctaggggctctggccaagcccggttaccctggactgttgacttacaagaaacagtgaaaagtccctttggtgcttaagccaatttgagttgggtttctgcctcttgaagtcagaagagtattgcctaatacaataattctgtgtaggcatacaagacacatcagtggtggtacctgccatgcccgcagccctagaggaggagacagccagcaggtggccctattttagatcatgtaacagttggacaagagcaagcaaacacctgactcaggctctgaatcaggctggtcaggatttgtgagttttcctctggcattaaagatgacctatgtctatccaatttctcttttttaaattggaagttgagaaacagggcaggagcgagacagccagctgcaagggaagaagcatgaaggatatgtgaagaggtgccactaggaggagctggcgtggtggcaactcagtttcaaagcagcagaaattcagcatcaggagagggcgccagttggtggaaagagctggcagagcacagtcaggaggaaacctgtctaggaagctccatgaagagagggagcaatggctatttctgaagttgtctcgcctattcctgaggacttttcaattctggttcaaatcctcatgcatccttataacaaacccattttttcccccaaacaagttgcaggtggtctgagaccaaagcagacatcccccttccatgttgcctctgtaaccctcccacggtgaccagcgtatcactaaggacacttttggtagcaaaggatggaaatataatgcaaattggtttttaaaaaaggaaatgtattgtcttccttaattgagatgtcaagggatgagactagccttagtcctcactgaggtcaaggctcccgggatgttctcgggaacttgcttctgcacatcctcactttgtccttctctgggcggctccagtatccggcttcatgtaagatggtggcttcatcgccacattcccttggggaatagaatgagtttctttctccagattcccagataaagtatttatcattggatctaagtggggtacacacttatcctgaacaatctctggccaggaaactgatacagtgattggctgaggcctagcatacacccctcctctaagacccacatgagcgtagaggaggtagagtgtgagtaatatctttgtggaatatatgttgaactgctggaagagagacttcaaataagattggcttaagcaagatagaagtttctttctccctcacctgcctgcaggtaagcagcctgggagcccaggtttttttttccccatcttgttgcttctctatccctaggtattgtgatgtgagatgtttcaccatcacctccactgcctagccagtggaaacggaaaaggcggaagaggagggctcgcccctctggttaaaagtgtcacctctccctacttcaatgctgctggtcagttacttggccaaatatagcttctaggaagtgaggaaatacagtattttttttctggatttccgtatctccagataaaaaacaagaattctttaaacataggagatgagtgtgatcgggggcaattagcaatctcagccccagcctgtcccattggccagtcaaatttccatgtgtcccctccccaggggagacaaccctaaagttgcatccagtgcctatgtccagctccaagcctgggacctgtggagggacagcctgcaccatcagatctgatgtggtttttgttttatttttgtttttttagacaagttctcactatgttgcccaggctggtctcgaactcccgggctcaagcaatcctcccatcttggcctcccgaagtgctgggtttacaggtgtgagccaccacaccaggcttctggatgcagttctttatggtgtgttgccccggaacccttacatacattgcctgcctccttacacccaatatgcaacagccagtaaaaataagataaacatggtgggaaacctcatccagaagagggaaaaacacacccaccaaatcctggtgggcagaaattgtgaaggctcccagggagtggagcagagtccttggatgacagcgcctctctccaggagtattccctgggatagacatctttggaccttggtggtcccctctttgtccactgccttccatggcacaactaaagggcatcaaacggtgtatccctcttagggctatacagcttaaacatttttttttagagagaaggtcttgctgtgttgcccaggctggactcgagtgcctggggctcaggcaatcctcccacttcagccttcagagcagcagggactacaggcacatgccaccacactgggcctgggctgcatagcttttgcagcccactttttgcaggtgcaggtttggtgggtaggggtcggttgatttaaggagtcaaaaatgcagacttgtaccagccagactcatggttctttggtaacacatgccccttaaaatctcagttggctttctgcctatttgtggctagttatcctctggggcaagtacaggttgggtatcccttatctgaaatgctcggggccagagtgtttcatatttcagattttggaatatttgcattatcctggctgaacatccctaatctgaaaatccaaaatctgaaatgctccaatgagcatcatgtgtgctcaagaagttttggattttagagcattttggatttctgggtttttggtttagtgatgctcaacctcctttagattagcagtatttaagcctaaaaatggtggccttttatttatcagcctgtatgttatatctattcacctccctctcaacctgagaccagcgaaaacactcaacttggactggaaggcagcttccttgatctggtctttgtggccgagcggctgtcattgtcaggttgagaaacgtaatcaagtgtttgagaaagactagggtccatagtctcgtctcctgctaatcctgcttcttcagaaaattattctatatctgcctcagtttgtggtacagaagcaatagatttttctctttatttttttaaataaatataattttattctaaaggaatattattatatggcaacactttgagaaccataaaggtgcctttgaaatgttgttagaaaatcacttaaatcatattttttattaataaattgatgccattttcaggcacagtatttttttgggcaagcactgtacagcataattcaaaatatacccatttacagaatccaattaggtatttttctgctcacaattatatgatggctgatttctgctcacaattatatgatggcggatttctgcctacattatgatgtgatatgatatgatatgatatgatatgatatgatatgatatgatggctgatttctgcctacattatgatatataactgctctacagaacatgaaacagaatttcataacatcagttatatttacactctactttaaaaatctttcaagatataagaatcaagctatcaaatatggagtttttaacaagcaatagtttttttttttaggtctgaaaactttttaaactgaggttatagcccataggcaaagggagcttctttcagcactgctgtattctcttcagtatctgccttcctcgggctagctctgtccacgttcttctgggtcatgtaggactctgttgagagtggcaagaagcatccagcaaacacctgcattctgaaatttccaactgtttcctttagagcaagagctgactttgcaaggtattgcaggaatcagttgatcgactgctatggcatggcataaacagggtttccagatcatcatatttatgtatagcatttaaaatatgttttcagttttgttaccagcaacacagcccttcttggtaataattagtatacagcctttactaataattagtatacagcactaataattagtatacaggctttccttctgcaagagagcactcaccccaaatagtgactgaaatagactggaggttaatttctctttcatggaaaacctagttagagctagtccagggctgataggcaaccacagtgtgttgggacacaggctccttctcttttgtcactctgacatccttagggttttagcttcatctgattgatataaactggcttcacaccatgacttcattcctaccaggggagagggaaaggggcgaggcacatttcttctgaagtgcatgaccgagaaattgcaaaaattacttctgctaacatctcactgctgagaacctaatctacagcatgttgggtgcacgatgcctgggaaatgtggtcattattctgggcagttatgtactcagttagaggaattctattactatagaaggggacaataagtattgggggacaattagcagtctctgtctcgggatgatcccccaaatgaaatgggggctggattgtggggagctgaaaaagcaacagatgtctactacaatgcctctcctctgagcactccagccccttctattcccttcaatccttgtgacctaattgtcctttgggcatctgtctcaggtcccctgaatcccccatcatgtaggctttggggccaaggcacctctgatttagcctatattgtcagcttgcagctgataattattattagggactcaggaaaatgtctgtggaactaaattgaggtagtaataggcatttctgaatcaactgccttccattcattcattcattcatccagccagccagccagccagcaaacatctattatatgctaagtcccagggagtcagtgtctttttgtcagacaaaaagacagccttttcatttatggctcttttggctagaggggtctcttgtaccctagagatattttgctagaaaagcagatgctgtttaactgaatcaaagctctctcttccttaggcattgatacatcccaacttagcatttcctcaaagcttgcacagaggctgtccccagcggtaatttgtgctttgggacagctcagtatcaggttcccttagtctggcaacagtgtcttgccctttcctttggggaaccactcttcactagtctctgtgacccactgtcagccctactgcagggccccaccattttgggaagagcagtgacacaggctggtcaattgaagagctctctctctggtccaggattgtcaagtaggggcagtaagacttgatttgtgggttgtttagatccagagatgtgaggatgtagatttaaggttgccagcaactttctttcccaagaggagagagactacggtacctcagtactacccccatcatttcttcttgctctgctattacataaagaagtcacctctttcctcctattgaactcctgaatctcagcccattgaggaccttattgccagtagcaattctggctcctgtatctcctgtccactccttctcaatgggtacttctccctagcagtcaaatgtgctcagttcgttacaatgtgcagtggatacttgtttctggtcactcaggcttcaacctccctgctggggaaaactgtcttgtgagcagtctcggtggggcagtgggtgatcctagagaggcattgggccaggtattcctccaggtatgtcgatccaagggcagagggcatgtggccatagctcggccaaacaaactgccactccactgggattttgaatcttgagctgagagacacaccaaggaccatggacaggaatcctttctgtggaggtggcactggggagcaagtggttcctcctgttgggatctggagtcacctggctcctgccttgaagaacatggctgaaagcattagcatctggagatccctgcgatcttttgacatatccccttttgcttaactttttttttttttttttttttttttttttgagacagactcccgctctgttgctaagctgtagtgcagtggcacaatttctgctcactgcaaccgccacctctcggctacaagctatcctcctgcctcagccttgggaacagggggactacagaaacatgccaccctgcccagctaatttttttttttttttttttgagatagagtcttgctctgttgtctagactggagtgcaatggcggtgcgatcttgactcactgcaacctccgcctcccaagttcaagtgtcctgattctcttgtcttagcctctcaagtagctgagattacaggcagacgccaccatacccggctcattttttgtatttttagtagagatggggtttcaccatgttggccaggctggtcttgaactcctggtctcaagtgatccacctgccttggcctcccaaagtgctgggattacaggtgtgagccactgcgcctggccatccctttttgcttaacttaaccagacttgctttctgttgtttgaaataaaagaaacctactacaggatgcagataataaaacaagcaagcaaacaaaaaaaaatagcattaaaaaaatgcctctcttgaccctacattccttcccaagtgacacctttcttctcccctttatggctgtgtttaaaagaggcatctgcacatgcaccatctctggttctctcctccagctcatcccccaacccacgccagtggcttctgcctctgccacctcactgaaggagcttgctccaagtgccctgtgtcaccatgatgtcccagtttcccactatcttttctgggtgctcctccatcctttgtcacctggtgactcacaaatgggtcctaagccctctcctcactctactctttccctgaagaccttatccacccctgtgacttcagcaaccaccccatgtccatgacacccagacttctgaaaaactccggtccttggctgggcatggtggttcacgcctgtagtcccagcatcttgggaggcagagggggcggatcacctgagatcaggagttcgagacctggccaacatggtgaaaccccacctctagcaaaaatacaaaaattagctgggcatggtgatgggcacctgtaatcccagctattcaagaggctgaggcggaagaatctcttgaacccgggaggcggaggttgcagtgagtcgagatcacgctattgcactctagcctgggtgacaagagtgaaattccatctcaaggaacaaaaacaaacagaaaaacccctccaatcctgtaatgtgcaacccacctgtccacgtggtgcctcaaacatcccagtgtgcccccgctggacccctgagtgcaccccacactcattcctcttctgtcagggttcagagtctcagcaaatggtagttggcccatgtggtcctcaggcctgagctgctctctaccaaagcaatctacacatatccatcccttccttcccccatgcagtgcagcttgtacctccaggacctgacccaggaggagctcagtaaatatttgatcaagtgactgatagcagcgataacactccacgggacacgttcacaaacaccctcttcccccagccctgttaggtaggtataattactaccactctgcagatgaggaaactgatgcccagagagatgaacagttttgcttgggtgtggggttgcacagccagtgaatatgtgggggagttgagattggaatttaagtgtgactccccatgctgggttctccctggacagctgccacagccaggggagcctccttgccagggcatgaatggaagaagggggccagttggacaaggagtgatgccctggggtgagggccagccagctgtgttcacaggtagattgcatggcagacatctcctgacacccagccccaagaaggcttccttgaaacacacagtgaggttcttggttcttgagatgtcctgggagctgagagccccaggtttggggcctggatctggcaccaactctcagtgtaaccacaagcagtccatcccttcttggggctcagctgacttcactaaagagggaatatgagtaagatgcctaagatgtggaagcagaggtcctaattcctggacaggggcagaagtgggtagtggcctcggcaaacaaatcccctatttgcctcctttaagcaggatccccctaccaggcagtgtgtgatggtgaggcccaagcctggggtctgacgtcgacacccctgtgggcatttggccaaaggcagccatctgccagaatctgagagctgctctcagacctcgctggagagggctacctggggcagtctgagtctctctgggcagactgaggtcctttgctacccaaacggggagaattagagatactgttggctcctgggcactggaagggaggaacgcaggcctctcagcacagggctgggccaacaagttgggggtcccggcacaggggacaacggagaagtgccaacattgggacccaattatgtgatactggggcccagagatagtacaggtgcctcataccacgtggccctgggtggacagcaggaatctattgcgagtggcgggaggccggggctgcctgtcctgcgccctgaagctggccagcggttgtggaaactgggggatattgagggaaccgtaggcccaggtcctcagcctcatagtgtggaacctggcgatcccagggcctgggctggcccccggcgtcacgggaccgggaaggcgctgtggtgctgcggggaattgcggagaagaaggcgggctccagtggaggtggctcatccccgcacggtcactgccctcgcccgctgttggggtccgcggctgggagactgaaggcctcaagtcgggctgggtaggggcacgtgggcagggaaaggggtggtagattaccagtcttcaggggcggggctggagatgcaaccctagggaaggagtctaccaggctgggctcttgaggggcaatggagggctccgggggccaggccaggccaggatcatggagttcaaaggactggagtgaggtttggggtccatgagagtggagctcagaggatgggacggtgggtccaggatttgggacctggggctggaaagtccgaggctagtggagaccaggcctggtatcccagacgaaagggccctataggaaacggggtctcgtgggcgggatctggagccagagaattgtgagaggcggagctaggatggagaaggcgagaggaaaggggtagccgccggcgcggagacctcaatgcggggcgtggtgcggagggggaactggagcgaggggcactggagcgagggggtggggctacgaggaggtggacttgaggggctgggtctggggccggagaatcgtggggagctgcgcctatacacccgggacggtggggttgcgtcggggaagtgggagtcttgggggttcgctgggcagcctggagaacaggcggtcgtggtgcgggcggggccgaaaagaccgaggacagtggggacccggcctgaggaggggtcgggaaggaggggtgggggcgcgcggacgcagatcccgggccgcggcggggcggtggcaggctccagagtggcacgggcccaggtgagcgaggtctccgcccgccgcccctcccgccgccccggtgccagctgccccgctggcccctccctgtacccggcgcttgctccgcgggccgggccgacggcggcgggcggcgtctcgcgcccaggccaggtcggctctggctccatcttgggccgcggcacctggcacctgtggcggccgcaggagcagcgcttcccccgcctgcgcggccccggcgggcgagagggtgagaggctggctccgcgcgctcccgttggggcggggggcgtggtgggcggcacctcccccttgctgagcctcagaacccactccttcccgctgcctgcgctcagacccccggcatcctggcccctgcccagcgcccagagcccccggtggccgcatcgcactccccgcgctccgcctctcattgtcctgtcctgtcccctcttctacgtctcctctgcccatcctcccattttcacaagtctgtccgggaccctgtctccttcggcctccacccctgctgccatcgctcctccctctccccttcttccttttcccctccctcagcctactgcgccgcctaccccgcccccagccttgctgccctttggcttctcctgtcccgcatcattaccccggcccacagccccatttgcctgcagtcgctgcctttgctcctgagaaggtctgtagcctcgtttcgggcccgtattgagcccccttctccctaagtccgggtgggctttgtgcaggaggggcgggaggggagctattctgggcgaggctgcgtggtgcggtgctttcaggcctttggccccgcagcaggggcggcctgtgcttggcgtgcagagtgcagctgggtagacgctgttactgcatacgggcctgtgtgtcccaggctggggcatgagtgcttgtgagcgtgcagatagggacacaccggccgcctaggctgcttctaggccggggcaccctctccacctaggtgccccccagggattgtgggcaaatcctccccaggggaggaagctcaggggctgttgggcgcctaggcctcttcctggtgagcagagcctcatccatggggccactgaccccacagttaccccagaaccctttcctggcacagcttgtgacccggggcatgtagcccttaaggcacgttcattgtgaagggcaggttttgtctcctccaaaccctccctttaggaatgctgcctgctgctttgcccagagttggccctgagtgttcctatcaggccccgttcactctggggtggattaaaccacctcctggagggtgctgtatccccactgtgcaatgggggtttgtgctgtgtgcattcctgcctggtccttgagaggtaaggtccatattttaacatagaaccagttttcctgcctgatcatataggtttgcttttcctgttttggttttgccggacacataagtcatcatccaaatgcttgccacttaactagaggggacttgggccaggcgctgtggctcatgcctgtaatcccagcactttgggaggccgaggcaggtggatcacctaaggtcaggagttcgagaccagcctggccaacatggcgaaaaccccatctctactaaaaatacaaaaattagctgggcgccgaggtgcacgcctgtaatcccagctgccgggagactaagacaagagaatcacgtgaacccaggaggcagaggttgcagtgagccgagactgagccattgtactcgagcctgggagacagagcgagactctgtctcacaaacaaacgaacgaacaaaaccaagaggggacttagatggatgccacagtgttgtctgagatggagcccacttgtggtggtcttggtagtcccctgggcatatcccaaaggcctgggctcctctgctgtggcagcatggcgggagctggactctgtacgttgactcaaaggtctctatgtttgggctagtctggaagtgtctgagaactgggggcttttactcaaaatgacattggttgattgctacataggtggttgatcttccagttgctgacaggtggaacctgaggcagcaggacagcctggcattggccacgggacatcggccacaaccatagcaacttcggcatcaaatggggcaggagagagaacattaaggtatcgttcaaagaatactagaggtcttggatacttctgtatgcctgttctttatcttgtcctaaaagatcttccgagggtccctttagggcaaaaccagaaccttctgtgttgttataaaggcagggtgggtgtgccattctgggcatttaaagtgcagactctagacttgtatgcatgcgtagcctcctaggttaacatttaaaataggctctgggaaacctagtttggtgatagggagactggggacactgatggtgacctggtcctaggatgggatgaaggtagcgaggatgggaagctagaggaggctaacctttggggtgtcttgatggcttctgaaaagggcctctctggcccccagtactaatacttgttataccatgaacttaagctgctcttgatgggaggggaaagagaagattattgttaacaaacactattgcagacagtgcacatgctgtcacatttggtcttcacaacaaccctgcagggtggggatttatttctgttttgcagattgaagaaactgaggctcaaagaagttaggggtccacctgtgagtacatgcacaggaaggggaagagcccccattggaagcagagccctgccccttcctcctcacccctggctccctgggaggcccctcctctggcccagtccacagcactgtgacaggcagtgtggaagcctctttcccccagtactcccctcagagcccttccttccttctgagctgggaaggccaggttgtagttagccaggccaatccattggggttctgaattagccactttcagctgtgtgttctttgacatttctgagctgctccaggcctcagttttgtcacctgccacttgtggagggggaatggggaagggaaccaatagatacatagcccacacgggggtctctgggtgatgactagccctgggtgctgggcagccctctggtgagacaggcacagtgggatgctcattgctcatggcttctcagtgggtcttggtgggggtctgaggacctcattccacctgtctcctcaggggccagaggctgctggcctggctgtttatggcccccctccctgggagggtggtggggtttggccagaggctgtgtggatgtccagatggggcctccctggggtcttggacctgcaactgagtggttgtctccctgccaggggctggcagtgaccacagctgtcccagtcaggaggaacacctcctgccctcctcattcttgcagcctcaggagctgctaagaagcatgttgggcaggtggagatccactcagtgacttgttccatggcatgtcatgagcacgattggcagggccaggccagatcagtaaaaagggtgagagctgcgaggcataggcctgctcagtgctcgaaggggagaggagctcagctgccccacaggtgtgtgcccttgggggtcactgagcctctctgagcttatggaattctcctgtctgtagaatggagataatgactgtctcaagaggttgcttgcacagttatatgagacaatgtatgcaaaggatgtggcacgtgtctggcccttggcgagtgatcaggccctggcagctgttattatcatcgctgttacgggctttattgccctcctttgtttgtatgtccatcttagagctcattgagggcagggtctgggtcagatttctctcttggctactcctcctcttcctgatcctcccagggacaagtctggcttcagccccgtgaagcagctgggatgggacatccttaccaggccggggctgtgttcagagctgcacagtcctgtacggtagccattagcctcatgtggccagttagattcaaataaaacttaaacattcagtgtctcagttgcagtagccccctgctgagtgcttggtacccacatgccattggtgcctacctattggacagcacagggtagaatctttccatcatcgcaggaagttgtgcagagctggagtctcagggactacagcaccagtatcatcctcactgtggctcagcagccaccagccatctcctgagtgctgggctgccaggacatttgtaattacacagaaaccgagtcccacagcccttcccgaatttcctctcgggtagccttgctcacctggtcggggaggttgttgcctggaagtctttatcagcctaggctgggagggcagggctgggattgcccaaatgcagctgctgcctcctgtccccaccctgtttctcccacctctcctgcctggcaaggagtcccagagtgatctccctaattcactgctgtggccagggccgaggtggcccagacactttgaccccactgctcccctcatatgctctggacacatggcctctttcctcctgcccactccgctctccacctgaacaccttcttgcttctctcactccaggcctgacttacgtggctggtcctccaggaagccttttctcatctctcaccctccgtgagctctcctgccttggtggtgccctccctcagaccccatttttggcactcagtgccctcctctgtgggtgtgttcttgtatttgcttgttctcttggtcaggcacacagcagataatcctctgagtgccgacgacacatcaggtcagtgctgggtgttggacagccagaggggagcaggccacaggccaggctttgccaacttcaggcctgtggggaggctgacagttggccaaactgttccatgcaggcccaatgctcagtcagggatgaaggctgcctggctggagggtcgggaaaggggccccaggaagagatgcagaagtggaaagggccagaactggctctaggctgcagctgccaggtccagggtggtctttatggctgggggaagtgacagcgatggtacggagggtgggggacaatgaggatgcaggtacactgggcaagaggggattaaatgtcaggcaggataggtctgattgatggtactgggtgggcatcttatctcactgctgcaccgtccccaggggtacagaaaggtctgaatgaatcccatgttccctagccctacagctgggcacgcagtaggggctcaggagatgctgtggaatcaatgaccagatgctgaatgagtccctcatggaaaaagctgatgcatggggcctctccttgcccctggagctagaggtaggagtcagggaaccccagagacatgccagctcagcaaggctaggccaaggaggatgggggtggttgtggaagcccagggtgattctcagtgtcctctggtcattgctccctcgtcctgtgaactttctctgagctcccactctgtaccaaggagaccctgtccacagtgagttggatactgccagtcccaggaggaagtagcccagtattggcctgtccagctgtgcccgttaagaggccatagtgcttccgtgctggttgaccaagagctgttatcccacagccccaccccctagggctgcagtttcacccccaaagccccagcagatttggctctctcccttcccctcccacacaaaccagccagtaaagagttgagagctgatagagtggcggcctccaggaccccaccctagggcagattctaactgcttgagactgatgatgagataatttgcagtgtcatccttgtgtctaatgtgagatgaccttgatttgaagtgtctggtgtcttgtcactcactgccttgcatatggttctgaccagtcaggcaggctgggactgaaggtggctccctggtgaacctagcactgtgggagttcatagtagaatcggcttaggtgctgccacccaactcaactccactccctccctttctctcttctgcaggcagccatgagctccagccgccccgagccgggtccctgggcacccctgagcccccgccttcagcccctgtcccagagctcttccagcctgctgggtgaaggccgggaacagaggccagagctccgcaagactgccagcagcaccgtgtggcaggcccagctgggcgaggccagcaccagaccccaggccccggaggaagaggggaacccgcctgagagcatgaagccagcacgggcctctggccccaaggcgcgacccagtgctggaggccactggtggagcagcactgtgggcaatgtgtccaccatgggcggcagtgacctgtgtcgcctgcgggcccctagtgctgctgctatgcagaggagccattcagacctggtccgtagcacccagatgcggggacacagtggtgctcggaaggccagtctcagctgctcagcccttggcagcagccctgtccacagggctcagctgcagccaggtggtacttctggccagggtggccaggcccctgcaggcctggaaagggacctggctcctgaggatgagacttctaactcagcctggatgctgggggcgagtcagttgtcagtgccaccactagacctgggggacacaactgcccacagcagcagtgcccaggctgagcccaaagctgctgaacagctggctaccaccacctgccatgctctgcccccagctgctctactctgtggcatgagggaggtgagggctggtggctgctgccatgccctacctgccacagggatcctggcctttcccaaactagtggcgtcagtgagcgagtctgggctgcaggctcagcatggggtgaagatccactgtaggttgtctggggggctccctgggcattcccattgctgtgcccacctttggggtcccgctgggttagtcccagagcctggctctaggaccaaagatgtgtggaccatgacctcagccaatgacttggcccctgcagaggcatccccgctgtcagcccaggatgctggtgtgcaggcggccccagtggcggcctgcaaggctgtggccaccagtccgtccctggaagcgcctgcagccctgcatgtgttcccagaggtaactctggggtccagcctggaggaggtgccgtcccctgtgcgggatgtgcgatgggatgctgagggcatgacatgggaggtgtacggagctgcggtggacctggaggtgctcggtgtggccatccagaagcacctggagatgcagtttgagcagctgcagcgggcgcccgccagcgaggacagcctgtctgtggagggccggagggggccactgcgggctgtcatgcagtccctgcggcgccccagctgctgcggctgctccggcgcggcccccgagtgaggagctgtggcccttggagctggcctgggcccactgacttagtcctagacctgggccagggacggtgggggctccgtgccccctggacccaccggcagctgggcacatctctcacctgaatattggctgcctccagaccacaggactgcagcctggggcttccggccctacacagctgggctgttttcttaagggcttgatttccaagggccacatctctgcaccttccgggctctgaactttgagacagggctttagcactgtgcagaggggagatcctgagttttctgtaaaaaatgaccttttgttcactccaccctcagaactctgccatgttgcctcgtcagactcttggtggctttatttgaaatcagtgctgagaaatagtgaattctcgacatgaaatgtgaggccccagtgacagggactgcccaggtctttagggaaggggactgatgttatcagaggcctcctgtgtgccacatactgtgcttgtcctgtcttcacctcttcatcctggcaagccttcatttggcaaggctgtagccgatgtgccccacgctggacagcttgaagaggtgggactgagatccaaagccagggccagctgagccgtgggtgttgccctgtagcatgtgcccggtccagtcagtgcagtcatgtatgaggagaatttactgagctcatactctgtgctgggttctgtggattctgtggtgaatgagacagaggctgcccctgccctggctgagctcatggtgtgggttggggatggcaggggaggatgctgaccattacggagggctgccaggcttccagggtcattgtgtcagaggctggcctgaggaaggggagaatgggtggccacctgccctaatctcagttacaaagcctaaaattgcactattttcacctcattctgtcggctgaaggatttctccccagctggtgcagtttgtggaaggagggagggcaggaatggagggggacagggcaggagtttgccctggccctggggtaggggctgtgaggctgtgggggctcgcttgcccacatgacctgacctaggctaggcagtgggggccaggggccttggagagacagaaacatgggctttggcacagtctgacttcattgcccaaagatttctcgaggcctgtgaagaatgggagtgggcttgtgttcttgtcctgggtctttgtcttgaagatcctaagatcccgtgacacagccccccaatccacccgtgtgagggaccagagggctagtgtggggtcatggcccacgacctggcctgtttctggagcctcttctgcacctaggagcccaggacccccacagtggtggcttacttttccccatcctcaaggacctggtactcattgaggtggaaatgactcatgcaacagttggtgaatttgtaaagcaggagtggcatttcaacaggccacaaggacaaagtgacaaaggcgtgcgtcaggtcagatgcctcctgaagcccaacgatggaccattctcacccgtaaacatgcctttcccatatgcataggtgcaccccttgggattctggggctgtcagtccctttgtgtatggtgccagggcaggcagctcacgttctggggagtgacacatgggtatatgccatcttcatgcctggctccccatggagtctccaggaaccccagcctgttagggccacatgagagagaacaaatggctgtgggtgcatggggagggacctttcacacagggccatagctaagtagggtcttgaggatgcaggggttagacaggtgggtggagagagggcaggacctgcctggcagatggaacagcctggtcagatacttggatgtgcctgtcctgcctgggccataatgagtttctgcagtggcggctcatttggagcgtttgttgggttgggaggtgaccaggggtccccattgtgaagatcctgatgtaaatgaggaaaggaactttaagggaactgtggaaggggttctgaggtgggaccagatttcagtttagaaatatccatttggcttccagtggagatgtgccaggtgacaccaaggaggggcctgtttaggggcaatggagtgggcagctgggggctgggttcatacacgtgcacacacacgcatacacaggcacacatgtgtgcaatggatttggggaggaggcatttcaggatgctgaggtttccagtttgagcaagaggagggtgaggccactacctgggtcaaggtgaatggcatgttcagcaggtgcagaaagggccacctgccacagggtttggctgggaccagtgaaacctacttcatgaagagactttcttctgtgtcacgtgcagattcttatgcattcacgctggctgggtgccactctgtgctacctccatgctgccctggcttgccaggatggcaggccgggctgggctcagccaagctcccactcacctcatcgtcactgagatgagtatttgcagagcggtgctgaaatccaacacctgtgtcttggctggggccccagatgattctcctggctaaaccacgatccttgtctccctagcccagttgcacagctgctgctgacaggtctacctgaagtgactgcagcctcatttctgattggaactggagacccctcccaaccccctttgctgtgccctctcctggaacagccctgatgcctgcagtggtttagggccccagagcatggccagcggtttagtttacagatctcctccccttggactctagatttctggccagactttctgggtccctttcaggccctgctctgggaggtgttggagttcactgttgatgtgtttgtttggctttgaattcaaaacagatacaaatttggaggtgagagctttgccagaccccagcagggatggggcatcggtcctgactggtcttgtttattttgtcctggtaaattctgttctttggagcataaaccctggagtcctagagccccttgcctcagcaggaatcccccctctgtctgctccaggggctccctgcttctgcccacctgctctccttccatggcattcaggacccccgacagctgaagcctctcttcatatagcttgtcccctctgggcctgcctgtcttgtgtccaggacacaagacacgcatcccttgtctggccccaggctgccatcactgtcacaagaaactcatagagtagagctggtctgaggtcacagtgctggtggtggtggaaaagcagggatggcctgttccactgtgatcttacctcctgtgtcacctggattgggtctctgtccccttagacatgctagatcctaactttacaagggctgaaggggtcttctacacgcaggtcccaacactttgggctggggttggccaccgtagcttagtgggctaaagctggagtttgaatctggatatataggatccacacctatagccatgtgatcttgggcaagttacaagccttgatcatcttcctcatctgtaagatggggatgacaatggtgcctccttcacatgcttggtgtggagattaaatagaataacccaagtagtgcctggcactgagttagtgctcagcacacaggctggtagtgttgggcacccctctcatagccacattcaggggccacctcttaccctgccagcttggctgtgatcacagcccacatcccacttccttaaaagtcccttgttcagagcctctttccaggttcctcgccccacagctttgcaccctgcctgggacttggccctctggctggggcttctgaaaatgtagttcccagagtgcattgaggagggctaccctagccctcaccactcatcttgggctgggttccccagaagcttctgctgagatgaggatgctggagttattagggaggggagagcaagttaagggaggggcagaaggcaaggcagggtgtgatttcagtccaagtcagaccctaaaggggagccctggatgcagtcccacctcagagtaaggactacccaggggtgaagatgtagcctccaggcacttctgctctctggcaggcaggctaggaagctctaggagccccagggtaggtttctgctggagtcgtagggcctattttgggggaagttgtgcacagaaaccaccagagggagtcacaggcatctgggggtgcacccattgacatttgcatccatgtcatgccaagcttgtagcccacaaatgcccaacccttttctccatgcattgctctgtctcagttttgttcacgccaagcagccttggttagttaaatgcagagcttggcatttgcccatgttaaattccttctcctttttcattctggcctggcctggttttgccatctgaagctatgacaagtcctttatcagttttcatccaacttgtcaggcagggcagggctggtatgaagcccaggacatatcactgggacatcccataggtctgtgagattcccaggtccctccaaatccacacggtcatcatgggcaaattagtttaagtctgatctgttaagatccagatctctcacaccaacagcacacacccctttttcccatggccatggaaggagggtagcatagcctgactcgagtcctcgttctcagcagaactggttctgtggtggccacttccctttctcaacttttacctacttctgtttaataggttgttctgcaagtctgagagcaacagcaagcttagaagtgtggactcagcctggtacagtggctcatgcctgtaatcccagcactttgggaggctgaggtgggctgactgcttgagctcaggagttcgaaaccagcttgggcagcatggagaaatcccatctctacaaaaaatacaaaaattagctgggcatggtggtgtgcatctgtagcctcagctactcagggggttgaggtgggaagatggcttgagcccaggaggtggaggttgcagtgagccgagatagtgccactgtgctccagcctggatgacggagccagaccctgtttcaaaaaaagaaaaagacaagaaagaagtatggactctaccttcttgcccttgtggagattgggaactgcctgcccttggcctctttcctgtccatcttgtattatgaaaggctgtttctggcacacccgggctcctctgtgtggtttctgggaagtgactgagggtcaggggaatggagcccctctgcagccggccgctggtaccttccctattgaacccttctttaggtttgctcactctttttgatgggtgtctttccaaagctggctggggacctccctgattgagagacatggggccagttctgttgctgtggctacacgggaataataaagcagaagaacacctgaggaaagctgatgtttactaaaaaaaaaaacaagcgaaaccaaagtgacgtgggcccataggattggggatgggtggtggggtctgactgccttgtcccaagagttgggtgaatgccgcctttgctcacttgtgcggtcactctccaggactcctgcctggcttctcccactccaagcccgagatagcccagcaaggaggaaggtctggccccaaaatacgagctccccaagtggatatcctaaaattcatctttcatggccctactttattgggagggaatgtgaaaattgtgggaatatgtccattgacatctggggctcagggcaggggagtgtgtctagttttaaggtgtgcgcttttagccatgcagtcatcgcccagtctgtcctgcctggagcttttcatttccctgcagctttcctgagaaaagacagagtgtgctttctctgcatcctatgaacatggccccaggactgcagcacctctgtgtgcacacagccaaggacagtcgggggacctctgctggtcctgcacccgctgccctgggtgctctgtcatccccatcccccatttctctttaatctgttcttcttttgtggtttcatgttctctttgttctgggttattcagaacctgtctgcctccccactgtccattgtacttgttcctgcctcctcctgctttgtgccaaggatttacttgccttcgccttctggctccatacagtagtctctcttcttgcggtcttggccattccccccaccaggcccccagctgtggctgtgtctgggtcttggcatttgtgatttacatgggtctaggccctttctctccacctgtccttcccctctttggacacaaaccaaaacatctgagcatctccttacagagggaggtctccctggggttgctgtgccaagtttccattgcttttgcccagaatgagaaatcagttgtcagtggccctgctgggtgaatggaaggactttggtcgggctggaagggcaccccatcagtcctaacttttggtggcccttgttggtggctggctggctaggctgctagagaggtacatcaggtgggtggcacccatctgctggctttaggcaggccatctcctcatccatgttttcagaatcttcttgcatggcttgtaattgggttggggtgtggcctgagcccctgtggggacacactgcactgtcccacctgtatgcttctctgctgtcaggaactggattcgtgtccaagagccaaggctagggactggaggaggagatttctgtctttgacccctccatattagtccattttcatgctgctataaagaactgcctgagactgggtaatttataaaggaaagaggtttaattgactcacagttccacgtggcccggggagcctcaggaaacttacaggaagcctcaggaaacttacaatcatggcagacagcgaaggagaagcaaggcaccttcttcacaaggcagcaggaaggagaatgaatgcagaaggaactaccaaacacttataaaaccatcagatctcgtgagaacttactatcacaagaacagcatgggggaaccgcccccacgattccatcacctccacctgatctctcccttgtcacatggggattatagggattacaattcaagatgagattttgggtggggacacagccaaagcatatcaccctcccaggcctgagcaaggcccaagcagggagcctctgttggggctggaaccctgggaggggtagaattctcccctccactcagatttgttccctgttgctgcccacctggcccctgccctgcagccttctgcctggccttctctctgttcacttctcatttttagcagtcaacagactgggagatggtggccaagggtgtcattttgtacacaagctttgtggcttttgtaagcccagcctgcaactcttgaggaaaactctttggtttgattttttttctcttcagagttgggggtattcagggagaggggcaagggcttcttgtgaagatttcaattcttgaaggtgtggaagcctcctgggctgggggaaggggtggggcaggaaccagcaggggtgtggacacaggggtctggcacctgggataccgtaggacagctgggcaggaagtcggatgctgctttattgaaatttttgatattttatcattttttcattagtttttattttaaaacactgctttaaaataattaaaatatgatttatcttggttaccgaatcacttagtgttgccttaaattttgcgcctagtccctgcctgacctttcctcctcctctcccagggctttaggtactcttagtccctgtgtcatagggactgggagcagataggcccctccgcccaccccacccctcccccacccctcgcccacccctcccccacccctccgcgttcctactctaatctcctaccctgatctgcggtgcagggcggcgctggagagggtggcttgcggctgatcccgcggtctggtttgcggctaggtgtgtgtccccggactggcgtgggtcccgggccaggcgtggtcctgggcggcgcggcccgtgacaggacccgacgcctcctggtgggcatttcgctccaagccgggaccctcggagcctgaggggattcgggagggaggagtcgccgtggggcggggcggggcggggcgggggagggctcccaaggccccgaggacagtcccaccctcaccgacaggaccgtccctgcgcatcccccacccttcttcatcttcgggcgctcgggccaacctggacagcagggcggaagcttccagaaaggacagagatggagaaggtgggaagggtggggctcaggcaggggacaccacggccttaggaatggaagacaggccccacttacctcttcgactccagatgcagctcatcctcacgaggggctggatgaagagggcttcctctctttcccccctaagctgtgcctctgagcctctgtgcaaatatggtggtgcaaacctttggtctgccttcatcattttgttgttgttgttgttgttgagacggagtcttgcaggctggagtgcaagtggcacaatctcgctcactgcaatctcagcctctgggttcaagcgattctcctgcctcagcctcagcctcccgagtagctaggactacaggtgcgcaccaccaggcctggctaatttttgtatttttagtagagatggagtttaaccatgttggccaggcagctcttgaactcctggcctcaagtgatccaccctaataaacttgctttcactttactctgttggctggctcttgaattccttcctgggtgaagccaagaaccgacgtagcctcccaggctgaacctcagtttggggctttaccccatgacacccgcaaagggctgggcttcccttcttcttggggagagggtcaaggaagtggctgtatcttgaacacccattcctctttccttccatgcgcacaaggcctctctgagctgctgtcttccttaggacactttcagctacaagtaagttaattttgaactgaaagttagctaaacaattattatagaatgttcaccttcccactgaagaatttaggaggtaactggcttctgggtgggctgtgtggctcagtgtggacatggattcaggttctttccatatttgtgctgtgccatctttagagcgtagtgaaggctgtccttagccccacgatggctgctgcatttcaactctggaattcagttgctggaattcacactccagtctgtgtgactccagggcggtcattttgtttgtcttttcaaaaatgaaagtaatacgtacttatgataagaatttaaaacagtacagacctcggccttttgttttattcatgataggaatttcaaatactgtgtaaactgaaggtctgatcctcgcccttgtctggaattcccgcagattaccactgaagatgttaataatttccatgggccttccacaaacttccttggtaatcacaagctcagacctctgaatattccatacaagtgagatcccacttagatactattctgtattaattctttaagataggccaggcatggtggctcatgcgtgtaattccagcactttgggaggctgaggtgggaggatcacctgaggtcaagagttccagactagccaggccaacatggtgaaatcctgtcgctactaaagatacaaaaattagctgggcgtggtggcgggtgcctgtaatcccagctacagtcaggagaatcgcttgaacccaggaggtggtggttgcaatgagctgagattgtgccgctgcactccagcctgggcaacagagcgagactctgccaaaaaaagaaaaaaaaaattaagatatgtcttgtagataatactgccacatataacaatattttctttattttcttcctgggcatattgtatggcatagtatacaagtgccttttaaaattaaaccagacttctttttctggactttatgttacacctcacattttttttaacttaatagatttatttcttagatgagatttaattaagagaaaaagtatgcagaaaatacagagttcccctacactttctcactctcatacactttctcctattatgagcttgcatagtgtacaacatggtacatttgttacaattaatgcaccaatattgatgcattactgtttcctaaagttcatggtttaaagtttactctttgtgttggacacttctctggattttgaaaatccatgtggtgtatctcccactccagtagcatacagaatagttggaccacctaaaaatcccctgtgctccgtccattcacccctcttaccttccccaggactcctggcaaccactgatctttttactgtctctatagttttcctgaatgtcacagagttggcttcatgtagcatgtagccttttcagacaggcttctttcacctagcaatatggatttaagcttcctccatgtattttcatagcttgagaactcatttctttttagtgctgaaaaatgttctgttgtctgggcatactgccatttattcatctaccaaagggcatcttggttgctttcaggttttgactattatgaataaaactactataaatattcatgtgcaggttttgatgtggacatatgtttacttcagttggttaaatacgcagggcaacattgctgtaagactatgtttagcttcataagaaactgccaaactatctctgtacaatttcgtattcctactagcaatgaatgagagttcctttttctcatataaaaataaatatccttgtatgtatagttttatgttcaggtgtgagtatatctgtaggataaatttttcatcaagtggtacatgtaaaatatctaccggtattggcaaattgctccccagaaagattgcaccaataatacatgaaaacgcatattttctcatacccacgccaatatttgattgttaatcgaactttaatattttggctaatttgataagtgaaggaacaatgtcttcctagttattgtgatttgcaatctgttccctgtgagtgaggttgtggtctgccggactgcgtgagtgagaattcctgttctggcactctcaagctgtgtgatgctgggaaagttgctgaacctccctggacctcagtttcttcatctatagaatgaggatggtaatgggtctttaccttattaattggattggaggatttaatggcatcattcatgtaaagtgccagcacagttcctggctcaaaataagggccaagtaaatgtaagctattattattctccaatatgttcataagcacttgaatttcttcatttctgatctgcctatgttcatatcaatttcccaggattttttcttattgattggttagagctctttgtatattaataacatacgtttatttttttcatataagttacaagtatttttttattccagtgtttcatttgtctcctgtttatcagatcctggctccaaaccagtgcaacatccttctcagggacacagcattttaaatcttacaaagcccctcatttcccatctgtcatttatgtctcaggacatccacatgaggcaagctgatgtatttttcagtaaagaaggagactttattgaccaggcagggcgagtgacttgcctaagggcacagaaggaattagtggtttgtacagactgaaatggagggtcctggcccctaggtaccacctcctccactcttaaagaaggggagagggaatctggaggtgcaggaaggaaaaggtcaaggtcatcatgacagacagcctcaccccatcccctctcagaacccaagagcctgggtccttttttttctgttaagttctgaccattctctcctgataaatcaagggaagaatgcgagtaaagggtatgtgttactcgggcgagactccctgcttggaaggtctaggaggggaggtatgtgtgtgagtgtgtgtgtgtgtgtgtgtgtgtgtgtgtgcattctttctgtcaagttgcccagcaggtgagctgaaagctggctctcttaacttggggatgagcaatagagtcaggtctcggttcgtcattttccaatttcatcagctttgaaaatattttaataataaaatccaagcatttgattttcctgactagttgtttattctgatttattggctatgcatggtgcctgaagctcctccaaactcccaagggtatccctgcatgtctcaggatgtctcttaacccagtgccatgtgagggacagaacctagaccaggcattcagagccaggtaccattgtgcctaccctactcactgctagatgatgctagtgaggtgctcacacctctctgggcttagtccctccattgtaaggcaaatgggaggcctgctgcctctgccttgctgggttgttggtatggctgaaatgaggggatgaaggtgatgtggaaaacttgataggagagtggctgccgtgtgtccattctggtctcctttgtctcatgtcaagcccagggactggttctttttctctcttcgggtctgtgacttctgggaatcctgcttgcctcggtgccccctggtgaggtggtgccatataggttgctttagcacatcaccgagagggactctccaaaccctatgctaagtgttcaccgccagaacacttgcatttgggccagaccgggctagggtacctaaccatagcttcctgggttcatttcacagggtggacagcaactgagagatgtccagggaaatttccctttttaagagataggggttctggggcccataagggcaggaagtatccccaaccacaggcaagttcatgaagcccatagggagtaggatggagccagttgccaggagcagggaaaggttcatgtctttgctcctccatgtacccagggactcagcaccacctgcaagttgatggaaaggcagaatctcagcacactctgagcccccgaatcagagtctgcattttaacagaacccctaggtgaggcagaagcccactactccagtatcattcattcattcactcacctagcaaacatgcctgaggccgactctgtgccgtgccctgtgctgacgaagaccggccaaaagaccttgttctggtcttcctgaagctcaggtggagcagacaccccaacggccaacaaatgtgaagattgagaactgtgatgggagcctgaggtgggagcagctaagcttccctggggaattgggggtcagggaagtagtcccaagaggctgagtacctcctgtgtggcaggggcagggtggcctttgctccctagtatcttttttttttttgagatggagtctcactctgttgcccaggctggagtgtagtggcgctaccttggctcactgcaacctccgcctcccaggttcaagtgattattctgcctcagcctcccaagtagctgagattacaggtgcccgccaccatgcgtggctaatttttgtatttttgctagagacggagtttcgccacattggccaggctggtcttgaactcctaacctcaggtgatccacccaccttgtcctcccaaagtgttgggattacaggcttgagtgactgcgcccggcctgtgctccagtatcaaaacctgcaagcacctacagagtggagggtgctatggtcagggtggtgctcaggtccagactgatggaggaacctgagcaggggcggggaggcatttcaggaagagggagcagttgctcctgcacaattttgttgcatcgggccaagcaggaaggctggagaggtgaggaagagccccgggggaaagcatggaccatcagggaaaagtcagacattgccctgttgctaaaggcactcctggatgggttttagcccggggagacctgaatcaaattagggtgcatagaaagaccatgatatccccttgatggggaggagaaagaggagaaacaggaggactaggagggaaagccgaggcgatttgactcagcatgagtgagatgtggggcagggagagagagagagagaaagacacaaagagagagacaaggagagacaaaggggagagagagaggagagagagagagagaacagagagacagaggagagaaagagacagaggagagagagaggggaacagaagaaagagaggcagagagacagtgaagagagagaaagagagagagattgagaaagaaactttgcatccgcaggcctgggccccatgcagcactgacagtggtaggcagccgacgtgaagcaggaggcacaggcagggaggatggacacagcacctcccacagcttctgagtccttggtgcagaatgtttatggcacttttcttcgttctttcttaagacttatttagtactcatcttttctcctttactccattgtgagcttcccaatgataggggcactgtctctctcatgtctgtcttcccacattgcttatatctaggatgggaaatgcaaggctcccaggcaatgcttagttaaaggggcaaagggctgtggtcttgtcttaagtctctgccaggctgaatgcctagaacttggccctcaggagggcctgagtcactgtgggacacagacttttaaaaggtgaaacagccaccagccaggggtgaggaactaacagcagacacattgcctgattttaagatgtactataaagctacagtaatcaactaagtgtggtattggtaaagaatagacatagatcaatggaacagaatagaaaattcggaagcagatccacacatgcacagccaattgattttcaacaaagatgcaaaagcaattcaatgaagataatcttgctaacaaatggtgctagaaaaatagaatacccatatgcaaacaacttatttatttatttatttatttatttatttattttgaggcatgtcttgttctgttgcccagactggagtgcagtggcgcaatctctgctcactgcaacctccgcctcccaggttcaagcaattctcctgcctcagcctcccaagtagctgggattataggcgtgcaccaccacgcctggctaatttttgtacttttagtagagacaggattacaccatgttggccaggctggtctcaaactcttgacctcaagtgatccgcccaccttggcctcccaaagcgctgagattacaggcatgagctaccacgcccagcctatttatttgttttctttgtataaatttagggggtccaagtgcacttttggtacatggatgtattgcatagtgtgaagtcttggcttttagggtggccatgacccgaacagagtgcactgaaccctgtaagtaacttctcatccctcgccctgctcccaccctgctgcccttctgagtctccactgtctattatgccatgccgtatgtccatgtacacacattatttagctctcacttgtaagtgaggacaagcagtatttgactttctgcttctgagttattgccttaaggtaatggcctccagttccatccatgttggtgcaaaagccattatttcattctttcttatggctgaatagtattccacggtgtatgtgtacacacacacacacacatctataaaatatattttctttacttaatcatctgtcatatacaaaaaagatttatcttgattcatacttcgcagcatatataaaaatgaacccaaaatggatcacaggcctaaatgtaaaattgaaaactaacagatacaaacaaagaagaaaatgtgtgaccagggttgggcaaatatctcttagatgtgacacaaaagcatggcctacaagagaaaagtgaataaactggctatctttttttttttaattattattatactttaagttctagggtacatgagcacaatgtgcaggttagttacatatgtatacatgtgccatgttgatgtgctgcacccattaactcgtcatttacattagatatatctcctaatgctatccctcccctacctcatcccacaacaggccctggtgtgtgacgtcccccttcctgtgtccaagtgttctcattgttcagttcccacctacgagtgagaacatgcgatgtttggttttttgtccttgcgattgtttgctgagaatgatggtttccagcttcatccatgtccctacaaaggacatgaactcatcattttttatggctgcatagcattccatggtgtatatgtgccacattttcttaatccagtctatcattgttggacatttgggttggttccaagtctttgctattgtgagtagtgccgcagtaaacatacgtgtgcatgtgtctttatagcagcatgatttctaattctttgggtatatagccagtaatgggatggctgggtcaaatggtaattctagttctagatccctgaggaatcgccacactgtcttccacaatggttgaaccagtttacagtcccaccaacagtgtaaaagtgttcctatttctccacaacctctccagcacctgttgtttcctgactttttaatgatcgccattctaactggtgtggtggttttgatttgcatttctctgatggccagtgatgatgagcattttttcatgtgtctgttggctgcataaatgtctttttttgagaagtgtctgttcatatcctttgcccactttttgatggggttgtttttttcttgtaaatttgtttgagttctttatagattctggatattagccctttgtcagatgagtagattgcaaaaattttctcccattctgtaggtttaaactggctgtctttaaaattagaaacttctaagctgggcacagtggcttacgcctgtaattccagcacttggggaggccaaggcaggaggattgcttgagcccaggagtttgagaccagcctaggcaacatagagagaccctatccttataaaaataaaaaataaaaaaattaaccttgtgtggtggcatgtgcttgcagtcctagcaacgtaggtggctgaggcaggaggctgaggtgggaggatcacttgagtccaagaggtcaaggctgcagtgagccatgattgtgccactgtactccagcctgggcaactgaccaagaccctgtctgaaaaacaaaatccaaaacttctactatttgaaagacacagttaaggaaatgaaaagacaaaccatagagtggaagaaaatattttcaaaacacatatctgataaataacttgtattaaggatatatgaagatctctcaaaacttaacaataagaaaacaagcaacccaatttaaaaatgggaaaatatttgaacagatgcttcatcaaaggaggtatatgactggccaatagttatgtgaaaaaatgcccaacatgcttagttatcagggaaatgcaaattaaaaccataagatcagaccaatgcatacaaaatggagtggcttaaaaaaaccctaacagtaccaactgccttgagggttctcagtaccaactaagaactcttgtacactgctggtaggaatacaagatgggatcaccactttgtcaaactctgtggaagcttcttataaagtcaaacaaatatttaccacatgacttaccaaacatactgctaggtacttacccaagagaagtgaaaaattatgtttgcacacaagcctatccaccaatgtttacagtagctttatttattatcaccgaaacctgtaaacaaccccaaagcccttgaacaaactctggtatatttatgtaatagaatgcttatcaataaaaaacaatgaactaattatatatatatatatatatatatatatatatatatatatatatatgatggataaatctcaaatgcattctgctacgtgaaagaagccagactcaacagctgcgtatctgaattattccatctgtgtgaattctggaaaagggaaaactattgggataggaaataaaggagagcttgccaagggctggagagtaagggaaaggctgactacaaagaggctcagatggatttggggagtgaaagtgtcctatatttttactgtgatggtaacatggttgcgtttgtcaaaactcatagaattgtacactaaaaagagtaaattttatcatacacttatatcttaatatacttttcagaaagcaaagtatgtaattatacagatcaacaggaagaacaaataaaaccatacaatactcacacctgcaacataactagaagacacagaacactataatcttccaattacccaagagaataaaaataagcaaccattaccagtggagctctttctgaagtttctgccccaaaccttgtcaccgagtaaggcagagcctggataaaactgcatgggaggtgcatggatcacctgaggtcaggagttggagactagcctcgacaacatggagaaaccccgtctctgctaaaaatacaaaaaatagtcaggcgtcgtagcgcccgcctataatcccagctactagggtggctgaggcaggaggattgcttgaaccccaggggctgaggtttcagtgagctgagatggcgtcactgcactccagtctgggcgacagagcgagactctgtttcaaaaaacaaaacaaaacaaaacaaaaaaacaacaacaaagagaaaaactgcataggagagagaacaggggaatagagtgctcaagactgagctaaaaccatccccagaaagactggaaacagcctagttgtccttcaatagctggatagttaaaggttagaccagcatggtacatccatgccccaaaatgctgctcagtagtcaaaaggaaggaactgttgtctcagaatgcggatggatctccaggtcattctgctgagtgaaaacagacaatctcagaaagctatctttgtgtgattccattgatgtaacactcttgaaacaaaattttagaaatggagagcacattagtggttgccaggggttaagcagatgtggctgtaaaagcgctgcgggagggatcccgcggtgacggagcactctgtatcctgactgtatccatgtcaacaccctggttgtgatgtggtcatacagtgttgcaagatgttacactggggaaaactgggtacagggtacagtgggcctctctgtatcattgcttacaactgcttgtgaatcatgactctacagttaaaaagctcggtgaaaaaaaaaaccctcatttacaatcgcatcaaaaaatgtgaaatacttggagataaatctgacaaatatgtgtaggacttgtagactgaaaactacaaaacattggtgagaatgaaaggcttaaatcacagtacgctaacaatagatggatttgatgaatgtaagtgaagggaaatagtgttgatcacagacctgaaatttttctttttcctttttttgagacagtcttgttctgtcacccagtgtgtagtgcaatggtgtgatcacagctcactgcaacctctgctccccgggttcaacaaattttcctgcctcagcctcctgagtagctgggattacaggcgcccaccaccacgcccagataatttttgtatttttagtagagacgggagtatcaccatgttggccaggctggtctggagctcctgacttcaaatgattcgcccacctcggtctcccaaagtgctgggattataggcatgagccaccatgtccggcctgaaatttttcaaaataaaatgctggtaagagggaaaaaacaaaaaaagcataggaagaagattttaggaatgcatagttagttctgctataacacaatatatgtgttcctaaaaaaccagtgctctatgcaaaaatcacataataaaaaccactgggcttatgggaaaagtggggttaaccgcacaacactccaaaattttgtcagtagcccataagaaacaaaaagataggaacttaataaaaatagtcattgagttttgcacgtttgatggttaagaaaagcatgtatattgcaataaatatgacacttgatcttgaaaaagccctggagtttgtgtgtggacgtgtgtgttaccagacatggagctgtaacaccagatgtggatggatgcagctcataacacacgaggtggatgcggagctgtgggcatttgaggcatccatctgggtgtattttggctcggttcagttgggtacaactttctgtgctcacctagagtttcttgtagaccacattgcacataagcaagtgtgaaattcacatcatgctcaaattgttccctaatactgtaactcaatctcatgggaacaaatttctgttttcaaaacaagtattaacagaatggactgtgcttgttaaagtcacaggtggcaatcatcaacaacttgttagacagtttgctctttaaatgcatagatttctaaatctaaaaattaggaaaaaaaaaaaaatgaaacctcatgcccaggtgtgaccatttcttgattgcatcctcacaggattttgggttgaaagaaaacaaagtccctgattctgccacagcccacccaagcatgtcctcagaggtggcattgaattgtcccattgcactgtcccctgttgtctgagactgcactgtgggccaaacacccatggcaggccccacggaggggactctgataccatgtcatctccactcagtcatctaattagatgttggtcaggtacccactggaggccggacagcacataaaggtggggagggggtttgtggggggcttctgatggagacgagtagaccaggtgagtactaaatgactcaatctagatgagaggaagaaagggtcataggtattcattcggaacccagaaggcctcagacaagtgctgtgcacctcgccctggacaacccagcagggtcaccctgcagctgcagggcaggctctgagcttgggcgggcacagactctgagcctgggcagcctgagggtacagagggtgccagaattaggcccctttcgttgcctttgggagatcaatgcctgcaagggccccgatgcagccaggtggaaggggctcagcgtggggacagtctctcccatgtgctggctggcctggggacagctttgcctctgcggattagtgtgagaggtcaggacccccatgaagccatgccccccccccaccaggacatgagaaggtaccagctcctggagttttgtgtcccaggcctggtcgggacacttgggctgccagggggcctggtcctgggccactctcaggccaactccaggctgaggaccgggagctggaggaaagggctggtggtctctgaaccactagcttccctgtggttcctgccctggtggctgaggttagtgcgactcccctcaatccagcccggtccagaacgttctgagttggggatgggagcttcttcccaccagagaaagcattgcaaacctttttgtggtgaaaacatccaaatggacagaaaactagagagggtggatccatgaccctatcgcccatcacccagtgggcccagttcttgactctgttttgccaagaagggggatcaagtccccagcttttgaagatatgccagactgggtttgaaaacttccgcttctctcagacagagcactttccaacccttggccctagtgggtccatctatgatgcggagacaggaatcccaaactcagagggggctgcgaagatctaatgaaggaacctttgtgaggggctccctggagaggcagacacactgagggtgaggaattcaggttggacctgtctccggccacagccagtccagggcttagcccatccttgctgtgtgccgcagccccttgctctcagctttgactctcacaagcctcaggtcctctgtaggcactatagagaggcgatagtcaggccccactccatcctcctcctccctgctgcccaccgaggttccttcaccatctggacatagccctgagcccgggctcagctccagtcccaaggcttgggcttgcagggcatcagctccagcgacctgccttctccccccatcgagggctgtgtgacgtgtgtgtgcatgtgtatgatgtatgtggttgtgtgtgtgtggtatgtgtgatgtgtgtggtcggcagtcagctgggtaggcctagacctgcccagtgaccccagggacaaaggagcagtcctttcggatcctcccagcgcagggatcctctgatggacaaggagacgctgcagtcagaggcactgtgttttcaggacagactgaggcaaagcattttggcaaatggccttggagccctgaacaccctgagaccttgtcaccgccaagcccccggaccaggtatacacagcaattctaaatttgctaatagcctcattaaaaagcaaaaggaaacaggtgaaattaattttcataatatattttacttaacccaatatatctaaaatgttaccatttcaaagtttaatttgtatatgactgagatattttgcatttctcttcatgctccgtcttcgaggtctggcatgcacccggcactcacagcacgtctcagtgggaccagcccggcttccaaggctcagcagccactggagacagcacaggtctagtgcagttgctctcaactctgctgtgcattacaatcacctgagagctttgaaaaagtgccagtttccgggctgcctgggaaccccctcatagttacatgggaatctcagggaggggtggggcagacaggggtcactgatcctggggtgggaggtgtcacagccccacggaagggcttcccatcagagggaacagcgtgtgcaaaggcaggggagtggggaagagcaatgtttagggggaactgtgagtggtggtgtgtgtgtgcagttgtgtgtgtgattgtgatgtgtgtgcacatgtgtgtgttgtatgtggtatgtattatgtgtgtggtgtatatggttgtatgtgtgtggtgtggatgtgtttggtatgtgtgatgtgtgcagttgtgatgctgtgtgttcatgtggtgtgtgtgtgtgtggtattctgtggtgtgtgtggtgtgtgtagtgtgtggtgtgtgtagtgtgtgtgtgtggtgcagtgtgtgtggtgcattgtgtgatgtgcatgtgtggtgtgtgaggggggtatattctgtggtgtgtgtgtggtgtatatggtgtgtgtggcgtgtgtagtgtgtgtgtggtccagtgtgtggtgcagtgtttggcatgtgtgtggtgtgtgtgtggtgtattctgtggtgtgtgatgtgtgtggtgaaatgggtggtgtgtgtgtgtggtgtgtggcgtctgtgtgtgatgtgtgttctgtgtgtgtgtttgagtggagagatccttcaacctgaaggatcctgagcctttctcttcaggacaggtgaggacaccttagctggtggctgtgtttcctgcgctggggagtcagccgagcggagccccaccatggctaggtgttacatatgttcagtatcacctctgacttcaaaaaagcgagcacccccatttccaggaatcgcctgggaaccgtttcaaaggagtcgtgccagccaggacagagagctgggaagcgggaccacaggagcaactctgaacagtcattggatgcgctctccaaccagctgctctgctcacctcaaagcacacaccaaagagagggagaggctctgagcccatgcgggtgaatcagggtgagccacgcaaatctgctggcccctggcagtcatggcagatgctgccaggaggcctccctcattactcggagtaggcttgaagtcatgctttccagtgtgaggtgcgcgagccaagcaaaggaggaggcctggtcaggaggggggagttccctgtgacaatggaatgaaaaggctgctgcagggcccagctggccctgggcacggtgtggggaggggaatccgcaaaccaggcagagccctccagcccagggcgttagttgttgacccatctttcctccccaccaccagactgggagtcctcatcctttgcgctttgcagtttaggaagcaatctctgaagagcacaaacctatttaacaatgataaaacttcggctttaaagggctgatgtggcacactggcactagagccaggacacatgagggagatctctcttctcctgctcagcagctggcctcccttctgagggcccacctcggactgactggaggacaccacttggaatggcaaagatgggggcaatgcaaaggccacaaggatggcttcatagacaggatgtggacttggcattgggcagacctggatttaaattccagctctgcctcagtctgttttccattaaatgaagatacttgtgcaagggttctgtgagaattccagtggctgaagtgtgaagcattccccactcagggttgcacagctgggactgggtgaacactgttagtaccctcaccctgtgtgctgcagctgcatcagggccagctgcccttctcacaagcacctatgcacagatagcccccatttcaccccaaaggacaactattcagagaattaccatccatcaagccagggcactccaatcagaggaaggtgtcacttcctggtaggacaactagaagggcaggagctattcactgagcataagaggaaggcatggtacaggtggggcatttgtggagagcaagacagggagcagagaagtttctggcaacatgctgctcccagaggaatagggctgccacacctggtaccaggaaactggggaatggccacagctcagctctgccactcaagaaccccacttgccacctgcataggaaaagacaacattgtggccacagaagggtgaggggccccacagaactggggatgccaggacacttggtccatgggaagctgccttttgctctggcctgtgcctggaagcaaaaccatcatccataactccatctaaggattcttagagcagatactagctggaccacaaggggcagcccaaacctttctgttccatcccatggcctggcccttgctggcccacagctcacagaatctgctggggctccccagctcaggcagtacaatactctgttgaccatacgctgacaggtcaggcactgctcttcctagttggacctgatactagtcatgattcactcacctatgcagaagcctgtgcatgcaacaaggcttagcccttctcccatggagatgaaccttttgttcctccctcctgctttcaccacccccaccctacccaaagaagaggaagaaaacagagtagctttggcaaccttttctacccctctcccaggcaagaaaagcagaagaacaacctgaagaaccaggcttctctcctatatcctccatctcgccttcagcctgcatcccttcttactaccctctctccattataatttgctctctgtacattttaaatcaatcaaattagcaaaataaatcatgaaaaccctatacatttataaacatagtaatatgtgatgctcataagatgcaaggagatgggtactttcatagtgttgatagtaggaatataaactgaaaatgctttttttggtaaggcaatttagccatttatatcaaaacattaaaaatgttcatccctcagacccaggcattcagtctcagcaatgtatcctagagaaatctaaaatacaaaagtcacaaagctcaatgcaagaaaatgttatcatcttgctaattacaaaagtggaaaattgaaaacaatttcaatttacaatatatggaactggttaagtaaatatagcaatgggatacaacattggacaggctctaaaacagtgtttaaccagaattattaaacattcattttgtagtatgaagtgactatagcaatgtaatacaacattgggtagactctaacatggtgtttattcagaatttgttttgttttgttttgagacagggtctcactctgttgcccaggctagagtgccatggcatgatcatggctcactgcagccttgacttccccaggctcaggcaatcctcctgcctcagtcttctgagtagctgggactgcaggcatgcaccaccaatcctgtctgttttttttttttttttttttctatttatttgtagagatgggatttcaccatgtttctcaggctggtcttgaactcctgagttcaagtgacccgcctgctttggcctcccaaagtgctgacattactggcatgagccactgtgcctggcctattcaaaattctaaatgtttactttgtagtgtaaaatacatgtggtaaatttattttaatatggatcctataaaatttcatatacagtatcaatctcaaagacatttaaaggtttttgtttcaaataataggaaattgaatgaaaaggaataaagcaaaatgttgactggttgtcatcaagtaataactgtgtattatttattttcattcatatattcctaaattttctaaaaggtttatactgttttgaattttttttaatctttaaggaaatcaacttttatagcttagagtgggtaaattttaattaatatgttccttttgtcaggaatatttgcaatctaaacacactttaaactttggcttttctcttgtaccaccctgttgccatttaccaaactatagtattcacagcctatatgtttattattgcttcagtcctcattgattgtatcctatggactatgcacctatttaatcctcatacagagtatactctgtaaagtatgctgtctgacactgaaagtcagaaagtttgagttgcttgctcaggacaccaaaggtcatcagcagaggctgcttgatactgtcagtacttttcagatagtcactctatcagggctttagtccacagtgctcctgtggatgctaaccctacctgggattgctctccttttccttgagccctcctgtcttaggctgttttgtgttgctataacagaataccataccctgggtaatttataaagagaagaaatttatttggctcacaattatggaggctgtgaagtccaagagcatggcaccagcatctctgctttcatgttgcatcatcccatgatagaaggtggaagggcaagcaagcacatgaaacagagaagggagggggccgaacttgatccttttatcagaaacccactcctacaataacagcattaatccattcatgcaggcagagccctcatgagctaatcacccctcaaagcaccctcctcttaatatcatcgcaatggcaattaaattacaacatgagttttggaggcaatgctcaagccatagcacttctcaagaagggcaccagcagaatatgcttgtgatcgctctgaatctccatcaggtcatagcatggaatgaaggtatctggtttactcaagcatccctcccacggcctgaggtcccaagattggattttctgttcccatcattggaaagcagaggaatccttgtggaagtgcatctgccttcacaggaccacaccaggagcaggaattgtaaaatccacctctgctctcccaagagagaaggagagggagggaaggagcacatttggcaactgagagcatgcaacagaaaccattccttggagatcctatggggcaagcaatggaagggacactaatttccatctggaaaagatatggccagagctctgacttcaaactctggaaggaaggtgggggctgacccctattgaggatcttctgggcaccagatgctggactgggtatttaattctagtcaatttattgagggaatgagactccaaaaggtgaaataccttacccacagtcatgcagctggtaggtgacagagatggagctgaacccagactcttcctcttatccagtcacataccgagaccctgcattgccgttggaagctatttgcctttcttctcagcactctgggtgtcgtttgcgtgctctctctctctctttctctcagtaacttcagactagagaatggggtaccaaggtcactgataaggaagcccagggcctgggggtaaattttagtgagtcggcagtcctcaatactcagacagatcatcttcttcatgatgatgaagcaccatcaggagcttaccatttggagagataggatggcttaaccctgaatctgtgcctgactggggtctcataccctggggattttatagtgtaagctcaggaaagggattctgatgcctgagcagagagaatgccctaattaagaatgacggccagtttggacaatctccctgaatcccaccgacaaaagaaacaatggcttcccaatgacatgggtctcaagatggacttgggcagagcaggaacatgcaggggggttggtggtcttccaggaggcagggataaagcccccagcaggaggaagggccccccaaggctctccttcctatctctatctctggtcagtatgagactgagtcattcacttagctaaggaccagacaattaaagcacaggaacagatccaagcagatgtataaatctattatatggtgaagtcatactataggtcagtgaggaaaggatgagttccttaaaaaatatattgacacatctggttatccatttttaaagaaaataaagttaaattcctatcacataccatgtacaaaatttccagatagattgaatagctaaatgtaaataaataaataaatacacacacacacacacacacacacacacacacacacacatatatattatattataagaaaatgttgtgtaaccttacaatgaggatttctacttaaataaaataggaaacctaggcgaggtgtaatggctcatgcttgttatcccagcatcacttgagctcacaagtttgagaccagtctaggcaacgtggcaaaactccatctcaaaaaaaaaaattagccaggcatggtggtgtgtgcctgtagtatcagctattcgggagactgaagtgggaggatggcttgagcccaggaagtggcggttgcagtgagccaagatcccaccactgcattccagcctgggcaatagagccagaccttgtctcgaaaaacaaacaaacaaaacaaaacaaaacaaaacaaaaaacaggaactctagagcccataaagagaaaaactaacttgataaatttggttacataaactttttaaactcctgattttgtaagccattaaacagttttttactagactagaagaaaataattgcaatacttaaaatagacaaaaggtttatatccctgatatgaaaagtttatgaaattaataataaaaagacgactataaaacagataaaggacacaaagggcaattaacagaagagattatacaaatgaacaatagcatgttacaagacaacagtgttgggataatgcaaattaaaattcatcagtttagcaaatgtttaaaatgttggtaccagtagtctaattttgatgacactataaattgctacaatgattttgagaattaacctgacagttactgctgacattttaatctggatgcccttggatgccacttctggaaaaggccagggatcataatcaaaacattaagttactcttacatcacaagcatgccctgatcagaacagacactgaccacaataaccaacaagactgtagcatacttaaaaatagatgtatacgagtatgctccttgtacaattgtttatgttagcaaacaaacaagcaaacctggaaacaatccaaagtttcatctatagggagaagaataactaaattatgaaggatcatcaatctggaaccactgcagctctttaaaaaagaaaaagaaggtaaaactactattattgccctggcaggatatccactatagctgtaaaaaaaaaaaaaaaaaaaaaaaagtttagaaaataaaaataaacaaaggaagtaattcaattgtagctcttcaaactgagatggtaataacagcaattacttaagtacagtgtaattatgtcttcctgggggttggttacatcttggcaaagtttatcacagcaagaattggttttggcttctggggttggagccttagattggagatagaaaaaaaacctcaaaggaagcattcctgtccagaaggtaaagtgattcccacccccctcttccctgctacaaaaggtcatggctttggggggcactgaggtctggcatcaacccttaagtttatttttcccataaggaaaagcacaggagtctcatgctagcactttagagaaccaagcatgtggatctacagttccagggaagtccctgactcggggacacccttctcctgaaatccccacactcagtcagggccctgtcatgtgttcccatggcccccagttctcttcttggtggcacataccacacgggtcatttatgttaggatatgtacctctttttccctccatgagactctcagggggtcaccatcatccccagcacctagacagtgcccagagctttgcatatacagggtaaatatttaccacgaataaatgaaattagtaaggggctacaagaacccaagatgattgaagagatataccaagaaatgatcaaatgacagccagagtgtcagtcactcagctggttccaaatgcctaataaaaattaactccctctgtccttaccacagccctatgaggtggccacacttattgtgctcactttatgatggggaaacaggagcatagaagttgggcaactttccaaagtcacaccgtgagcgattccacaacaaggggttgaacccaggctgtctgggtccagaggtcttgttcttaaccacagtgggctgctgcctcttctccctaagctagtgcatcctggaggtcctcagaatgacttgaactggccagagggtaaacgtctgctgaaggaatgaatgggcaatgaatttctaggaacctggggccctggggtctgggaaggccgttgcctccccaagggaatgacacagggccagtctgctctccttctgtgtgggcccctggacactggtctggcattgtccagacaccaaagcacatccgcatagcatgcatcaaacaaatggtgacctgctaatgaggaaatggctaaaacaggaagccatgaccagagtacatgcttcatgcctccagccccgcattgggtaatggaagggcaattacttctccacctcttcacctatacagggcagacttgcctagaagttcagagtccttcctgccaatttggcatcctttcttccagagtgttcccaggctaggtggggatgggaaaagccacaaggagcacagcaggatgatagagatgtggccaatgggcaatgctggcactgccaccctggccagaagagctcactgtgggacactttctcattgtttactagggaagaggaggttggtttggaattcattttgatttgttgttgtaaattctctttgctgtcccaatttaaacaaaaaagaaaatggagaaggggagtttttaatcaaatggattttcacttgggttttatcatgaacctggaactgctttgaaagctgaagccagctgggcttctgggtcgggtggggacttggagagcttttctgtctagctggaggattgtaaatgcaccaatcagtgctctgtgtctagctagaggattgtaaatgcatcaatcagcattctgtaaaaatggaccaattggcactctgtaaaatggaccaatcagcagcactctgtaaaacggaccaatcagcaggacatgggcggggccaaacaagggaataaaagctggccacctgctccagcagtggcaaccagtccctttctgcactgtgggtgttttgttcttttgctcttcataatgaatcttgctgctgctcagtgtttgggtccgcgccacgtttaagagctgtaacactcaaggggagggtctgcatcttcactcctgaagtcagggagaccatgaacgcacctgaaggagcaaattccagacgcccacctttaagagctgtaacactcactgtgaggtccacagcttcattcttgaagtcaccaagaccgagaacccaccagaaggaataaattcctgacacagcttgattttgtctttggtgagaattaagaagggtcacatccactgatgaccagttgggggatagatttacactggctatgcccagtggtactcaaagagccacaattactctcactgtggagcttccttcagtgacaccagagaccaggaagggagctacctaggagacctcagcctgtggaaatcaaactgtggtgtgagccctcctgttagcgagcagtggtgctggctgccttctcacactgccacttggcaaccagaatacagggacttcaccgtgagtttgagctaaaacttgcctgctagtgaatcttagcataggtaattttgggttaggagaattttggtttctctgatgacttggttgacatctttgagattcagcaagccccaattcagattagacttaaaacttatcagtgcaagtcagacagcagtgattactctgcttgttgagacctagggacatccgtttgaattcagtccgcaccccatggacgagcccagctcaatgccaggaagtttatgaattcctggggccttctagtctcatggttacatctgctgccaaaaaccagatcctatgaagttagttcagtttagtgatcttctcaccaagctgcaggggccatcctgttttgtaccatggtgatgaggcacagagcacaccctctttttaccttcaaagaaagaagccagacattgatacaggttactgtgtatgcagcagactatcctgaaggtttagggagacagagtattgatatctcagatctgcaaacaacagaacagccccttggggatcactatgatccaggcagaaggcagaatttgttttttaatcaaatcaccaattaatgactgaaaacagtatctcctggaacaagaaattattattcctctaggcttgaaacaatatgaaacagaggaaagttatttgcaaaaattggctgaatgtgcaaattatgcttccacgtgaatagcaaagtaattaaaaccattttcagaaagtgaactactttcttaaaacagcatgccgaaagtggtccagagttcaagattttgaaaacaaaaacaaagttggtacttgaattcacagattgaagctaactagaagtcaaagaaaagacacactggattatgagaaggagcagggatcacagccaggtgcagaacaaagtctgagcgtgcctgaccttccctggaggttccgcccatgtcacctgcccactgggtgtttcctgttttgaccatgcattccttagaccttctgttgttaaaattttttctccttgagaactttaactggccagaaattagaatccaattttgaaaataccaagctactttcattatgacactgcagttaagcaaatattacccaaatttggacagccttgtccaaatttgttttatattgttttatatttagcaatataaagcaaagtgtcccatttaaaaattggtaaaaccttataatcaatatgcattaaaaatttttagtatcacatcattattaatggcaaaaatttccatttataaataacagaacttttgttgattgtatttattcttccatcctgggatttggggttttttcaattttgttttttaagtttgtttttaattttttttttttaattcagaaagagaccttgttgccaccctctgcatactcagaaaggaaccccagtccgtgcagaaaggggccacggacagtggctgtccacccaggatgggcccaagaaaggagtcgatgtcctgaaacagtccctgcccctttcctgagtgttgggggatggtgggaacgacgaccatgtagctcctaacaaagggcgtctgcctctgggggtgtcctggggcgtggcttactgagggcttactgaattttaaaaattcagatttcagccaggcacggtagctcacacctgtaatcccagcactttgggaggccaaggtgggcggatcacctgaggtcaggagtttgaaaccagcctggtcaacatagtgaaaccccatctctactaaaaatacaaaaaaattagttgggtgtggtggcatataattgctgtaatcccagctactcgagaggctgaggcaggagaatcgcttgaacctgggaggcagaggttgcagtgagccgagattgcatcattgcagttcagctgggcgacaagagcaagactctgtctcaaaaaaaaaaaaaaaaaaaaaaaaaattcagatgtccagcttttcatgaaaaaatccaaagttctggtcacacgctggacaacaatagccataggtgagcacctgctgccctgggaacaggcacgtgccctccaggtggtgaatgacccacttctctcaccagcttcaattgtgtccatctaggacatttggaactcttccaggctgctgcactcaccaatggcaccttcctggcctcatgggcatttgagtttgtactcctggccaggacctaatgctgcagaccagataacttcctgggttcttgccctaaaggaggagctgaagccataagcgcagacctctaatgtggctcagagacactgtggagagagggcagtccaggcccagggtcttgacggtcccgcccctggacttattaggccccctctgcatagctcatagtggcagtgataccagacgtcacctaaaccttcccactcctgcggcacccactaccattcagcctcagggccatcctaaccttaactccaggctcctctctcacatgggactattccagctctgactttagctcccatgaagaactggctcccgagtcctggctccccatccaggacccaggttccagtcctctcaatgggctctccctgatagaggtcaccttgggtctggtggcctaccccatttcttacaacatacaccccacaccagccttgggccagccacctcctttgtgccccagaatggctgtcagggaagaccctgcctgtgtgccccaacctgtgggcaaggcaaggcctagggctctgcccaccaggaataacagacccagctagggaaaggcaggctttgagatgcacgtgtgatgttgaccctccccccgggtcaccccaatacccgtctgcctgattctctgttgccccacagggtcccagagagtgctgagctgcacatttgacaggctatgtgcccatgggtccaatgtgtccatggatgacctgaattccaaggccatcaggaaaagcctattgtgttgggcccccaggaagccaagccaggctggctaccctgggatcttcagaggagagcagcctagcttgtacagatcccctccatgggccaggccctagaaatttcacacaaaaaaattatccttttttacagcaactcatgagagagaccatgaggataccattttacagatgagaaaactgagagtgaaggaggtgatgcaaccaatgagtgacagaacatggacatgaaacatgtcttggcaactccagtacccaagatttctccatgtcagctgtcagcctgcctggctcacaaaaccttcatccccagtgtagaaaggactgatagacaagttaggggcttctctctcacagggcccttgtgtgtgcccacccttcacacacatacacccattcacacatacatacatacatctgcacacacaaacacctatggggtccacacacatgcacacaaatacacgcacaaacaccctgcatatccacacatacacacaggcatattcacacatatatacgtgcacctgcatacaaacacacacatagacacaaacacccataaatatccacacacacacaaacatgcacatacacacaaatactcatacacaaacaccctacatgttcacacatacaaactcctgcactcacacaaacaccttccatatccacacatccatacatatatattcacacacacacacacacgcatgctcacacacacgagcagagcactggaccaggagcaggagctgggactctcgtcccagatctcccatcacacttctcaagccttggcttcctcatctgtgagatggggttgtgccgcctgcttcccagagtgttgcacaagcaaacatgcatgacagcccaggaagtgagaagggtgtataggaggaaagggtcctgatttttggcagaagttgcccagggagtagtgagtgctccacacctttgtatgtgctgtaccttctctctggagctcttttctcttcttctctggctggtgaactcatcctcaccttccagctccaacaaccacactttgtgttcctgatgtctccctgtagtggaattcctccaccatcctcagtgtccccagctcctgtgtgagacaggacttcctacactggagtgggacacgtgaatgaggctgcatggctcttcggagccggatgagtcccgacttctcctgccacaacccaagtcccttcacagacccacagcacagtctctcagaggtatcttttaaggccagaccctggccttccctttgacagcactgatgcaaagctcctgatgtgactaggagtttaagaaccccctaagtgcccctagctgcctggtatagacctgccagcctctgcccatcctgcttcatctgctctgaccttttgctctctggtggagtccttgccatgatggcctgggcccagtctggtctggcctagggaggcgcttttctgcccaggcatcagggcctgtcctcacgcagagttcagaacacacagaggcaccccatcactctcgaggtaggcctcacacctcgcaagtcagcctcaaaaaagcaagtatgaggcaggatcccctttctggctttgggtaggggctgcagttcctcttgccatgtggaagcttcttaaatattgtactacaatatttaaaaatattccctttgttctacataccattaatagatcaactcttctacagctctgcaatcacttctgacttggcaaagctgagcctgagctcagggaagggctctggcttcagccttgtgaagcagaaagatcgtggactctcgcacaggacccctgtttacatttctctcaagcacagcctcaccttctcagtcctgctccaaaaacaccacacaacttccagttctgagaatgcaccctgttctctcagccctgggctttccacatgctaaccccttctcagaacctcccttccttcacttcgatacctaactgatttctattctccttcaaaaccccattctaacatcacctcttctgggaagcttctctgacttctctgaggccctcccaggctatcatttccttcctgataatggctccttatagcactggccacttatatggaagtggtgcatttgagtctctcccactgcaccatgggttttcaatggaagagtgtgtgtatcattcctctttgtaatcccagctctgtcatcacaagatggaattcaagcatgtacctggtagttgatcaagctctatattcatagagcccaaacccaaacctaaaccaagaagaaagaagaaaataatagaggctagtctagaaataacatagaccaggctaattccttaataataaagacaatagagaaaatacttccccaacccttgctaatgccaatgggaaaaaaatagagaaatctttaaaaaccaaaattggttatttgaaaagattaacaaaattggcaaatctttaactatactgaccagaaaaaagaaagattaaaatcagaaatgaaaaagaagatattacctctaaccttcaaaaataaaaaattataagtgaatgctatgaacaattatatgtcaataaattaaatgacttagatgaactggagaaattcctagaaaaacacagaaaccaaacctgactaaagaagaaatagaaagtctaaagaaacctttaacaactaaagagatgaaattagtaatccaacaactaactgcaaaaagaaagccaagccccaatggcttcattggtgaaattaaacatttaaagaataatttgcgttttaaaaatatttgcatttaaaggagcttttaaagaaaaattattatcaattcttcacaaacttgcaaaaagttaggcataaacacttcccaactcattctatggggccattactattctgatactgaaattagacaaagacatcacaaaaaaagaacactactaatacctcttatgaatatggatacaataataacaaaatactagcaaactaaattcagcaacatataaaaaggattatacacaatgatcaagtgcagtttgtcccaggaatgcagggttggtttaacatccaaaaaatcatcaacgtaataccatattattaattgttctattaatactatattaatagaataaaagatcaaaacctcataatcatctcaatagatacagaaaaaaatgacaaaatacaaaactccttcatagtaaaaacactcagaaagaataaaagagaatttcctcaacctaataaagcgtatatactaaaaaagcagcaacaacaaaaaaaacatagataacatcacatttaatgggaaagacaacatgctttccttctaagatcacaaaagaaacaaggatgtctactcaccacttccattcaacatcatactgaaggttccaactattgcaattatataagggaaaaaaaggcacccagataggaaagaaagatgtaaaatggtctcaattggcagatgacacgatttttctatgtagaaaatcctaagcaattcacaaaaaaattaaaatatgtaaatgaattcagcaagattttagcacatgagatcagtttgcaaaaatcaattctgtttctatacactgtcaatgaacaagacaaaaatgaaattagaaaaataattccatttacaataacatcaaaaaatacttaggaataaagataacaaaagaaatccaaatggtatattccgaaaaatataaaacattgttgaaagaggtcttaaaagatcaaaataaatgaaaatacatatcatgtttttggaccagaagacttattgttaaagatagaaatatcccagagttaatctataagttcaatgcaatctctatcaaaatcccagatgacttctttgcagaaattgacaaggcaatcctcaaatttatatggaaaatcaaggaatgcagaatagccaaaataatcttgaaaaaagaaaaacgaagctggagtactcacgttttccacattcaaaacttactagaaagctacagtaatctaaacagtgtgatactagcataagaacagatcaataaaatagaactgagagtccagaaataaatccatgatctatctacatacatctattgtcaattaactttttttttgagatggaggcttgctctatggcccaggctggagtgcagtggtgctatctcagctcactgcaacctccacctccctggctcaagcaattctcttgcctcagcctcctaagtagctggaattacagacacacaccaccacacctggctaatttttgtatttttagtagatacggggttttgccatgttgcccagctggtctcaaactcctgagctaaaagtgatccgcctgccttggcctcccaaaatgctgggattacatgcatgtgagccaccaggcccaactgtattgtcaattaatttttaacaagagtgccaagaccattcaatgggggaaataataatcaaataatctcttcaacaaatggtgctggaacaactggatatccacatgcaaaagaatgaagttggactcccatcttacaccatatagaaaaattaacttaaagcgggtcaacaacctacatataagagctaaagccataaaactcttagaagaaaacataggagtatatcttcataattttagctttagcaatagagtcttagatatgataccagaagcatgaacaacaaaagaagaactagataaattagacttcataaaaatagtaaactttcgaacatcaaagaaaattaccaacaaagtaaaatcatacatctaataaaggtctggtatccaaagcatttaaagaactcttacagctcatcagcaaaaacacacaactcaattttaaaatgggcaaagacttgaatagacatttctccaaagaaaatatacaaatgccaacaagcacatgaaaagacactcaatatttttattaattagggaaatgcaaatcaaaattgcaatgaggtaccaattcacacccactgtatatatatgtaataggtggatggatatatataatatttatatataattatttataatatgtatatataataatgttattatatgataaattatataatacatatataatttattgatttgagacaggctcttgccatgttatccaggctggagtgcagtgacaccatcacagctcacagtggcctgaacctcccaggatcaagtgatcctccacctcagcttcctgagcagctaagaggtactacaggcaggcataaccatgccctactaatttcttaatttttttgtagagacaggatctcactatgttgcccaggctggtctcaaattcctggcctcaagctatcctcccaaagtgctggcattagaggcatgagccactgcacctgacttaggatggatatatttttttcaatggaaaataacaagggctaacaagaatgtagaaaaattggaaccctcagacattgttggtgagaatgtaaaatggcacaactgctgagaaaagtttggtgatttctcaaaaacttaaatatagaattatggtatgatcaagcaattccactcctaggtatatacccagaagaactgacactgactactcaaacaagtacatgtatctttatagcagcactatgaacaatagccaaaaggtggaaacaacccaaatttccataacaaatgaatggataaacaaattgtgatatacaatggaataatagccataaaaaggaatgatgtactgatacatgctggaacatggatgagctaccaatttacaggaaacacagaggacaggggacatgttgaatagcaccatgagagtgcagtcagcaaaatccagactattggaaactctacagatcaaatgacctgggtcttgggagggggtaggaaaacctgtgtattaaccaacttttaaaagatgtatttttataaaataagtgagatttaattatagggtgtagggatatacatgtgggtaataattagactatgaagcaaaggaaaggagtgtctactgtaagtcaaggtagtggtgactttggagaagagagtgaggaggtgcctctggacaaagttctgtttcttagtctaggtggtggttacaaagctttactcttgtaaaaatccattaagccatgcatttgttttatgtggcttcttatagctttgtttatttgcaaataataacctggttcagagattctgattcacagggtgtggggcagagttcaggaatgcttttaaattttcccgtgttgtgtgcgcacacacacacacgcatacatatatatctgtcttccacaccaggctggtgcctgtttgaggaaggtctgtggcttgcctcaatttggacttcccaacctccagaactataagaaataaatttctgttctttatgaattacccagcctcaggtattcttttatagcaacacaaaacaaaccaagacagcttctatctctctcctactgacctatgagcagggcatgctttgtttctgtctttgcattcagcacctagcacacagtaagtgctctgtaaatgctgatgaggctgggctgatacacaggtggactgacagtgggcataccagacaagatccagtggcccctgaagcagtcaactcacccacagcaatgctggagggctatgaacttcccaatctcactgaggaccacaggagcattccacctctactgggcagtaaaatccagaacgccggctgcagacattccacttagagtcatgccaacatcctctctgggccccactagcttaagacagagccacagacacaggcgtccagaattaagagtccatctcagccctgaggctgatttctcactacacactgaccctgagaaaaacttcagggactgcaaaaggcagccagaaacactgggagaagggagggaagaaagcgcctctgaaatagacagaaacactaatgcaccaccagtgcctctttcagacataagccagtccagctccccatgggcaggcccaggatcacacaggacactacaaaccaggtctctgcccaagaaccaggctgtaggggccaccagagcctcactggaacaggttaatgcagaatacagtcatgtacgtccaaacggagctacaggccttccccgttaaagacagtgccctccccggggtagaaaggaaaacaatactccttatcagcatgaccattgtatgttaagtcttgtgatgcatgtttgcaagttactccaagtaactatggatcttgtccccaactcaggccagccagctgacaggccctgaagtcagcagctacagttggctgattctgaacccagtgatgcctgctgtttgcagggaatgagatacttacttaattatctcaaatttaaacactcttatatgtttccttaatttaaaaaccatacacacacagaagtgaggacatctaaaaatgggatctgcgttactgatgtgtaagccagaaaaaaagaggagttctcaaatacactctgagctggacttcacagctacgccagttcctcaagtggttcgtggaggtgagcggcagatgcaggccagtcttagaatgtgaaaaatctgagagctataagacaattcaaaaacagacaataagtcaaatcccattgaattgtgttattttaaatataaagaaagaaatgtacaaacatttaacagaaaattagattccccctgtccccacaaatcaaatccaaaattacccatgtgaaaacttcacggcattatccactttccaccaaggcctccacgtgctcgttctctggccaggccttggtagtgtggactggtcaccatgtaaggacagccttctgtgagctgcagaccaagggaggtggcctggcagcctgttggaggccaggcaaggataaaatttactatcaatccttttttttttttttttgagatggagtcttgctctgttgcccaggctggagtgcagtggtgtgatctcggctcactgcaacctctgcctcctgggtcaagcaattctcctgcctcagcctcccaagtagctgggactacaggtgcatgccaccacacccagctaatttttgtgtatttttagtagagacagggtttcaccatgttggccaggatggtctcaatctcttgacctcgtgatctgcccaccttggcctcccaaagtgctgggattacaggcatgagccaccatgcccagccatcaatccctttttatgtataagaaataggctcagagaggccagatggcatggcccagtttgcacagtaaggtgattgcctgtcacggccaaatagccaccacgtccggataatccatggccactggtttctgtgaggtggtggagaggcggcctcagcctgagccctctggatcgtgggcaacgggtggtgtgaggaaactgtccagcagtgatctactgtccctgcactcccacactgcagggccaggggtgcatctgcatcccacgcggggaatgcctgggcatgaggcttcaagaagcacttagcaggaatgcaccgggtgctcagaggagccgctgtcctggcaggctttgctgtccacatttgcccctttgcacggagcctgctgtccctgaagtgctctgacctgtccacaggaaaccaggtcaggcacaaaataaccacccttgtctcaaagcaagggccctaatgcctccattccttcaatgccttttccttcagccaaggtcccctgcagtcttgtcctgggcactgaactgggtgctggggatgggctggattatgaggaaggaaggtctctgctctcaagaagaagtgggtcccccatcctagggcagaaggcactgccatcctgagtcagcttatcgcagctcagatttcactccctctgtgctgggccctgggaatggggagatgacactgccatggccctgccctcaggggctccccatcacgtggggaagccagacacaaaggtaaatttgggaggaagcccccaatgcctcataagctatcaaaaaccagagtccacagcaatgggaaaaacaaggcaaggaaggtaacctgcaaagaaacgagggctggggaggcaacacgcaaacagccagaggagactgtgaggaggccccccacagactcatcacctcaaagcggagccccaggaatgaacagtcagctctaggacgtgctaaatgccccaggagaggcacgaaccaggggaccactgacaccactcggccttcggaggtgagaggcggcttcccagaggagggcatattggctgagcaggatttcctcaggtagacacagggggaaaccaagcatcgcaactgaaggccaggtaacacagatctgccgaaagagacatcatgattttcaaacaagcaaacgaaagggattcattctattctgcaactgtcaggcatactcagaccaagagtaatctttcaaataaaccccagaaaatgaaatcacgtatgccatgttctagccccgcagtggaaagtggtttagcctctggtcccggagtcttgcctgtctcttctcccacccacctcccctgcctctctccccttcccagctgcccagaaggtgactaactgcatgtccacttttttttctgctgattcttcccatttctgatattaagtagcactttctctgcaagcaaagctacactgatataatacagatgaaactgggaaagtccaggctaaatttcaggatacgtatacagaaatgcgttgagatacagcacctcactcagcaaccatgccttatagatagtgctaagcttcagtcgcatcacagaactttctaccctgcatgagttctctgacctggctgtgagcttcttgtgggtggggtctcagtcattcccaagcagccagatgtgtctcagtgcctggcatacagaaggcatatgataaatgtttgctgaatgagtaattcacaagtaggtccattgttataaatgaatgttttggaaacacaagctgtcactgagttccacgtgtcgtgttctgctttcgaatgacctgccctgaatatatctcacatgcagtcttgcatatgcctgattcagacttttgctcacagctacggggaggtgttgagctctgcatgggccagcagatccaggcagaaagacttccatgtctgtacagcagcatttgttcattgctccaatggtttattttcccctggttttattaaaatagtgaaaaacactaaagtggaagggcttacactcaagagcaacacaattggaatgacagcatgggttttcaggggtgcccaaagaagtccttcccctctgttgtatgtccctaggtcttaagccactacactgaattcatgtgtgaaggaaaggaacaaaattcaagggtgtgtatgaaatgctagcaatatagccttgaatgctgtacctggatgtagagcaggaagcaaggcttgtaccgtctcttccttacctctctgagaagggaccccaccccaaattgatctgctctggctccgacacaccccctacatacgacccactctgtggaggcaatagggaagtcctgctctgtgtctgaaaatgtcaaagacagcttattcctgggaagccatcaaatacgccctgctctgctgtatatattattcaagtactcagtaaaccctttgtttctggagagcaaaggccactggcagcccaacctctgcccagacaaggaggggacaggcagggagctggcaagggcacacaggatcatggccagagggtgagctcagtgcccagaatctgtccccataggagcacagggtccccaggctttcaattctccagacttcgtttcccagcctataaaatgcgtacaaaactgacatcctctcgggatgttaagattcgatgatattacaaatgtgaaagcactttggaacccataaactgctgtatcaatactggttgatcgtgctcttattaagattattctattaataacccatctcaaattacatatctgtagacagtgcgtttgtgcatctattgggccagctgctctccaggccgggaagccagaaagatctcatggaggagctggtcctcctacttccttcccttgctaaggccaaacctgcccgaatgagcttcatctagagggcacctctcaggctcagcacctggagcagccctccatgtggacagccgggcctgtccagcccaaccagagggggccgtggattttgtccatggctgtttcccagactccatggcagtgatttagatgcccctgccccctggccgcacgctggaacatgtgcacctggtttctcccggcactgacctacttatccatcagttactcaactgtctactgacgtgtttattgagcatgtcccaaaggccaggtaccagaccacttgctgcatgtgacatgcagacacatatggaaccaggccagcccttgaacaatcacgacaagtgtcccaagtgctacaaaagagaaggaagggatgatgttgcagaaagtggggagggaggggcagtgctaacctgctctggggtctctctcgaaatttccttttgtttgtcctgctgacctttctatgcatgcttttactctgaagtcacaccttttcttaacctgtagaaaattctcggtcatgtcattctaccactccttctactgtatcttctctaccattctctccacattttctccttcagaacattggttgttaaaactcagccattttttaagttctcttccatagtttcatctccttctatctgtgagctgcttttagttttccattcgcaaattgtatctttgactagctcatctattgatttaattatcatagtttttatacctagatttctactcagttttttttcagagccaatctgttcttaatttataccttcctgggtttattttataattactttttatgaatgctatttcttcttctttgtgggtcttaagatgcttaaggctttttggttttgagatttttctcatatttccatttatttggcagtgaattcatctcctattattagttttgtaacctttcttagaattagttttttcacatgcttcaaaatgttcgcttgcaataggaattctgtgttttgttcttcccactgcattaacctcccagacccacccgcaccctcccaggattttgtcattgctcccatctggccttctagagtacccagtcccaaatgaggcttgctctgacagctccgaggttctgaaatgccaaaacggaggagttagccagtccagtcattggcccagggcctggcccaggaactacctttgagcctccctttgcccccttttgccctcttaggcatgcaggtcttgctagccttagccctggtagcagttccagtattttgcagccacctgtcacaggtggctggatctgccctcgctcccagttcccatagcccctgacgcaagtgagatgctttgggctctcaggtcctttgcccatgtcagagcccagaggtgtggtctcactatgctgtggaaccccagctgacagaaccactcactgcccagggatcctcagggaggttgagaagggaaagcagattgctttaaaggccgccgttataaagccatagccaaagcagctgtggcctgtgaaatggacctacgagaaacacagcaagagagaaggtgtgaaaaccaggagcgcctctcagtccctgcatgaggaagcaatgtgactgtttgatggccctgagttatgtgggggtcatacaggccccttagctatatcatcattccaacagcacaaagacatgaaaaaacctacagtttgcaagcagctgccccagagacagactggcaacaccatgaggccaaatcatacaattgcacagagaaggcagcccttctgtgtgcctgtgcagccttcctccctcaactggcattgcacctagggcaggccctatgtccaaagtgagcagtgatatcagggttacttgcccaggtcactgaccagtaaacgacatgtatgtgtcaccggtcagttgctattggtataaacacttcttctgtaatatatatggcctagtatccatttgggatggttccaaaccataagttggggttctccaggtttggaatggtgcatttcagaaggtaaaaataccagaaattagactacaagaaaatgatgtgttagagaggagtgtggggtaaggagactaacagcagagaggcaggcaagattcaacattttgagatttattttgtgttattggcaagccttcataggctttttagcagggtactaacaaggaaatatttaggaagaaaactggtagccacatggatgagctgttggagagaaagagactagagacagtgtctggagtcaggccagccccaggttccagttttatactcctctgtaggtgcttttgttccaaccttggtccagattcactcctaaattcatcagggtttccactccttgaagtcaaagaggtctaatgaacacagcactttatgcatattacctttctcagccatcaaatcattacaaattagaacttggaactggagagagcaagttacttgcctaaggacacagctattagacaggtgtatgggcttcccaagtgatgcaccaatcctccctctccccaagcaggatgcagagggcagcaagggaggggttccaaatgggtgatgtggtgctctcgcagcaacccaaggctcaggttcagctctagccctcagtactgagctaaaactggccaggtgcagtggctcatgcttgtaatcccgtcactttgggaggccgagttgggcagatcacttaaaggtcaggaatttgagaccagcctggccaacatggtaaaaccccatctctactaaaaatacaaaaaaaaaattagccaggtgtggtggtgtgcacccatagtcccagctactcaggaggctgaggtgggagaattgcttgaacctgggaggcggaggttgcagtgagccaagatcacaccactgcactccagcctaggcaacaaagtgagaccttgtctcaaaaaaaaaaaaaaaaaaaaaaagaaaagaaaataaaaagaaaaaagacagtactgagctaaaactgaagacagttagggaggccctggtcatcctctcaccccttctcccttcatgtccattcacccccagccccaagcccagccagtggtcactggggccacacgtccccatctttgtgctttgcacatgggtcctctgacccagctgcctcccacctggatctgcctgaagaactcttcaatatacagcttctgttatcagacgctcatttcggggggacagctgccacaagtgtggcctctgcagccagagatccaagttcaaatcctgattctgcctctagtgagctgtgtgatcacagtcaagttatttcacttctctgaatctcagcttttcatctgcaaaagctgtcccaaggtcattttaataaatgcatacaatagctgctgcgaagcgctcagtattgctgagaactactggcgtctataaagttctgagtcagggttaacagctgtggcatgtatggtaattgtttgcttgcgaatcatccttcccctcagctgcctgtgagttcctcagggagaggagccatctttgattcagggctatgttccagtgcctgaaataaggcatacctcggaaatgcttgttaaacaaaggaaggaacgtgagagtgaatgatgacaactctctttgccaaacattctaccagtgactcctttgcgaaaactggctgcaggatggtgattttgatttgctgtaaacctagtgccaattgcttccatctgagctttagataggtgaagagcctcccctcgccccgggagtgtcacatctatagccagggcaccgtggataatccattaacacggattccctctctgcagcctcaatgaccctgtcagttcccagctgctaagaggttgcctcagccatgacctgggaccatgaccatcatacctgattcacctggacctcccacttggacaccctacctggacaccccacctgggaatcctacctggacatcccacctggacattccacctggacatcccacctggacatcccacctgaacatcacagcttttgccttcctggcttcagaaaacctaaagccaagcctggccacaccctgggagtagcagagctttggcctcacagaagcagcagatgtggagccaaactttactgtggcctgaggacctggctttgaacctagctctgctaactgactttatcaccttgggcaacttacttagcctttggggacttgatgtccatttatctaaaatggaaatagtgctagctatcgcttcttgagcactcatcaaattgacagggaaaggcctcattgttatttctattcagcatcgccttctcaggagcatgggtccaggtttctggaggatacctgaggaccaggagccctgatgtgtgggccgcacgcccacgtccctgcccagacaggcctcccctcacattgcaatttcagtccttggctgaaattcagtcccttggctattatactgctcccaggtggggaggagttgagagttagagacaggaaagaccaagaagaggaaggtgggagaagactcctctctgtgtttataaaaatgcttttggatgcctgctagcatcagaaagattttagctgccaattaacaaacagtggccacagctgaaggtgacaagatgttccttgcatcttaagctgatgctactgtttgcaagacatgagccttacattatgtcaaaaggtgtttactgaatgaatggatgaatggatccatcagctcacaggattaattaagattttcatcatctgaatgtgaaattatgtccatgtgcagagcctccattcctgcccagcggcttcatcacagccaggtccctgtctctcctgggtcccctcaatggctctccttcctcccaggtgtctggggaaggacagcagcagtaatccagggacagcctttatagcggatgaagcactctgccagacaccgctgccctatctctataggattctcatctccactgggagaaaaatacttactattataagctgcctcaaattatttccaacaccactaaggaactcatggtaaaatataaactcaataaagagctgggtatggctcttaccctgaggatagggtgcagctgcgagctgactgttctgagctctgccttagaacagagtggcagtgtttcctagtgcccaggtgactctctctgctgggcctgctgtggctcagccctagatccaacaaagagagggcaggagcacagcctaggccttcttctggcatcccagctcactgtgggttgcaactcaccagtgggtgtgaaatccatcacgactgagaccagtaagtttttaatgaaatgaaatacaaaaaaaaaaaaagttagagtttgtatatgcgtgcatactgtgtcacaccgtaatttgttttttttttgttgttgttttttaattttattattattatactttaagttttaggatacatgtgcacaacgtgcaggtttgttacatatgtatacatgtgccatgttggtgtgctgcacccattaactcgtcatttagcattaggtatatctcctaatgctatccctccccccaccccacagcagtccccagtgtgtgatgttccccttcctgtgtccaactgttcgcactgttcaattcccacctatgagtgagaacatgcggtgtttggttttttgtccttgcaatagtttgctgagaatgatggtttccagcttcatccatgtccctacaaaggacatgaactcatcattttttatggctgcatagtatcccatggtgtatatgtgccacattttcttaatccagtctatcattgttgtacatttgggttggttccaagtctttgctattgtgaatagtgccgcaataagcatacatgtgcatgtgtctttatagcagcatgatttataatcctttgggtatatagccagtaatgggatggctgggtcaaatggtatttccagttctagattcctgaggaatcgccacactgacttccacaagggttgaactagtttacagtcccaccaacagtgtaaaagtgttcctatttctccacaacctctccagcacctgttgtctcctgactttttaatgatcgccattctaactggtgtgagatggtatctcattgtggttttgatttgcatttctctgatggccagtgatgatgagcattttttcatgtgttttttggctgcataaatgtcttcttttgagaagtgtctgttcatatccttcgcccactttttgatggggttgtttgttttttcttgtaaatttgtttgagtcataatttgttttttgttgttgttttgctattttttgagacagagtctctgttgcccaggctggagtgcaatggcacaatctcagctcactgcaacttctgcctcccaggttcaagtgattgtcctgcctcagtcacccgagtagctgggattagaggcacccaccaccacacccagctaatttttgtatttttagtggagatggggtttcaccatgttggtgagacgagtctcaaactcctgacctcaggtgatccacccgcctcagcctcccaaagtgctgggattacaggcgtgagccgccatgcctgacaggtaatttgtatttctaactgtagattgtagtcaaagtttgaacgggtcagccatgcgcacaatgccagcctgcctacaaatgtagactggggcctttgactcatgcctgtaatcacaatattttgggatgtcgaggcaggcagatcacctgaggtcaggagttcaagaccagtctggccaacatggtgaaaccccatctctactaaaagtacacaaattagctggatgtgttggtccacaccagtaatcccagctactcaaaggctgaggcacaagaatcacttgaacccgggaggtggaggttgcagtgaatcaagatcatgccattgcactgcagcctgggcgacagtgtgagactctgtcccaaaaaaaagaaaaaaaaagagtaggttgggaagccagtaactaggaacaggctccatttaatccatcacaaaaagaggatttgagcagagaaggcaaagacaaacccttgggcaggcagcatctgctctgctggacaagctgttttcaaccatacctaatgatggaagcagggactacattgtccaaagcaaggatcttgggacccagtgggggctcaacgcagcaaagggctgctgatatgctcatctaagatcctgatgggtgcccgtttcttacagaactgtgtgctcacagctgtgctcagtgggccacatggtcctgcccgtctggccagcccatcttggttccactgtgttcctggagtccttactgctaggctctggctgatgctagcccctgtgatgggctgcccgccccacatttcccctggctggtctccactctctcggctactccctgctctgtcccataaaagcactcaaggcagccttctcatctagatcattctttaggcctggagttctttaatctgagggcttttgcacaccctgaattggatgcaaaagggggtatttgtcccatgtgtgtttttctgggaaaaggactcacaattttaccagactctcaaaagcatctgtgccctcagcaaaagccccaagccctgcctcaggaagcctgatctgctcaggctgggtgactatctgtccgtgtctgtcccccccaaagtggcgttcagcaactgatgctggggcaaactgccctgccatctgccagaatgtaaagcatcagctgtgtggaggatgggcggggggctggaccccagccaggccctttcaaaggcactaggggtttggctctagcatgcatccctgttgtgggtggcaaaaaccactaccgggagtcaggctgagctggcttaaatcccagttctgtctctggctcattctgcctccataggcacctgtttaacctctgtgaggctctgatttctcatctagaaaatgccgataagaagatgtaccttccaggattattgtggcaattaaatgagatactgtaagaacagccactttaccgcctataaatgctattttttttaattgactcagtgaaaaacattttaccattttaaataccctcaacccctgaagcactgcagctcttagctctatgacctcaggaaaattacttatttctgtcaactgtcctacttctgacaaatggggatggcttcatgttggtgttcgcaagatgacaagtcaacacgtaggaagcacttgaagcagggcctgggtccttgtacagtcttgcactgttatttctgcaagaaaggagtggcaggtgaagagtccctcccttagactgtgcctaggagcaaaattgccatttctgtctgtcttagtccattttttgttgctataaaggaatacctgaggctgaatactttataaacaaaggaggtttctttggctcacagttctgctgggtggaaggttcaagactgggcctctggtgagggcctcaggctgcttccactcatggcagaaggtgagggggagccggtgtgtgtagagattgcatggtgagagaggaaacaagagggaaagagagtggtgcctagctctttaacaccagctctcacaggagctaatagagtgagaactcactcactacctctaggacagcaccaagccattcatgaggaacttggccccatgacccaagcacctctcaattaggccccacctccaacagtagggttcagttgttcttcctgcctcctgagatggagtcttgctctgtcgccaggctggagtgcagtggcgtgatcttggctcactgtaacctccgcctcccgggttcaagcgattcttctgcctcagcctcccgagtagctgggactacaggcatgtgctaccacggctggctaatttttgtattttcagtagagacggggtttcaccatgttggccaggatggcctcgatcttctgacctcgtgatccgcccacctcagcctcccaaagtcctgggattacagacataagctattgcgcctggcctaggggttcacatttcaacatgaggtttgaggggacagacattcaaactatagcactctctctccttgcctctccttgccgatgggccaccagaaatctctcttcccttcttcaccaaacactgctccacctagacagtggtgcagttgccagaaggcacatgttgcctagcacagaacctcccattctgtccgttttattggcactgtgggctcaaatgctaatgaaacacatggcaagacctcgaattcagtccccatttggttggtgaggaagaggccctactcactgactttgcattcatcacctctgaccccatcacgacctctgagacagagccaagaagcccattttatagatgaagaaaccaagcctgagtggggtaagcacttgcccaaggttacacagctggcaaagggcagtgaggtctgcctagacctcacttgctcctccatgccatgaagctctcttattcacctctttgttagcaaatgtcttaaaagcatttgaagtgcctgaaatgtcaaaatccagctggcatccccattagggagggctcatccactgagtggacagattatggtgacaggtacctgccccggtcttcccacacaccccagcaaggggtcatatgtactctcttccacagattgcacctcccgagttttctctctctcacacctcccttctcaccaccatacccttgacccagtaatttctcagaccctacatgtctccaccagcccacgtgcccattagactcaaggagaggaaacggcagaggttcaacctagcaagcccaagctctgggttttctggctttccctgagtgattgtggcagggggtgggtcactgaaggttatcagcatatcactggcttgaccctgggtgggaggcagggagggcttcccgctttgaggcgccccacccccacccctgtgaacagggtaattatggatagactgggctgagtgatggcctggggtctcgggcatctgcaggctgcccccaggctgaagcatgcctgccagtggcttttaggcccatatgagctggagggtccttccttccttcccaggctcacagaacccctgtggggctgctgtgagtcctgtgaggccacccactaagctgccaccccagccaggcagccttggtaggaacagcccagaccaaagggagattggagccaggaaattccacggtggtgggactggcctgctgtatgcacagattcaggctctaggaggccctgggaagggaagggccctgcccacacccacagtccctcagggcaccccctggctaggcttgtgtttcccccctaagaagacctttacagagcccaggctggagtcctggacgtgggtgcaggaagggaactcagagcttccaggcggggctggcagccacacctctgctgctcctctgccaggccctggcatggcagagccagcctgggcggggaacggcaagaggagcaggaagcagagagagggtttctgtgggggtgtaaccgcccaaggggttctcctcacctgctgcccagatagccgatttatcatgacaggagaattgtaatagagaaagactaattcatgcagagccagctgtatgagagaccagagttttatgattactcaaatttttaagtctccctgaaaattctgagactcaggtttttaaggataatttggtgggtagggagtcggaaagtggggagtgctgattggtggagtcagaaataaaatcatagagtgtcaaagtgggattattttgctgtcttcattcggttcctgggtggcatcgcagaactggttgagccagagtaccggtctgggtgcctgctggtgcattggaacacagggtctgcaaaatagctctagcattaatctgagtttttacaacagtgacgttagccccaggagcagtttggggaggttccaaatcttgcagcccctggctgcgtgactcctaaaccgtaatttctaatattgtgactaatttgttagtccttcaaaggcagactggtccccaggcaagaagccaagaagcggggttgtttcaggaaagggctcttatcatttttgttgcaaagtaaaactataaactaaatttctcccaaaattagttctacctacccccaggaatgaacaaggatcgcttggaggttagaagcaagatggagtccgttaggtcggatctctttcactgccatcattttctcactgttataatttttgcaaagtcattttcagggggaggaggagtttcagtgctggggcttggaatggcctggcatcctgccccaaggagcccaggaacccacctcgggctgcaatgggatcagagctggttcaggggtaagggtcatgtccagaacaccctgggactggcatggaaagccctggaggaatggcagcaagggccatgcgtcagaggcccatatctggccacccattttactcaacatggggccagagtcctgagggcagtgacttgctaagaccacacagaaagaatgggggtgagtgggaggagtagtgtcttccagattgagcctgcggaccagaggcagcctgagggtgtgaaagggccgtggccaaagagcactaaccctgctcaaaggtggccctctttgggccgggtctcaccagcagccagtgagcgctgtggtttccaagcaagctattcggagtgcaagccgtctgaggaggccccacatccaaacacagacacaggcatgagcgcgtgtgtgcattcacacacacacatgagcacgcccatgcacaccccgcaccatgcacacacacatacacacatttcaaccagaagaatttctcttttctctcttctgtatcagattttgatgactgaagccaataaaattgcttttttaaaaaggcagtggccacagaagaatgggcacctttgggagtcagaagccactgcaactccatgtcagggcacttacagctctaagattgctgaggtcaggaagtggcgagccgggttcacataccacacacataactcacaccctctatactacacataccccacacacaaacacacatcacacacacaaccacacacaatacatacaccccacacacacacatcacacacacagccacacatatcacacacaaccacacacatcacatacacataattgcacatgatacacacaccccacacacaaacacacacatcgcacacacaaccacacatgccacacacacaaccacacacatcgcatacacacaatcacacacaatacacataccccacatacaaacacacatatcacacaaccacacacctcacaccacatacacaccacatacatcacataccacacacaccacatataaccatacacatcacatacatcacacaactgcatacaaccacacacaatacacaaccacacatatcacatacatcacagtcacatacacacaaccacacaaaatacacacacccccacacaaacacacaaccacacatatcacacaaccacacacactacacaccacccatacaaccacacacatcgcatacacacaaccacacagaccacacacaaccacacacatcatacaaccacacacacaaccacacaaccacacacgacatgcacaccacacatataccacacaaaccacacagaaccatacacatcttattcatcacacatcaatcacacactacacacaaccacacacactacacacaccctacacacaaatccaaaaccacacacatcataaaaccacacataccacacaccacacaaccacacacatcacatacatacaacacacatataccacacacaccacatacaaccacacacatcacataatcgcatacaataacacactgcacacaaccatacacaatacacacactccacatacctcacacacaaattcacaaccacatacgtcacacacacaaccacacacaccacaaccacacacatcacattcatcatacatcacacaatcacacacaaccacacaccacacacagtgcacacaccccacacacatacacacaccccaaacagtacaccacacgtgaaacacatgccactcacataccctacacaatacaacacacacacaaaatacacacacagcatacacacatcacacacaccacataacacagcacgcactacacacctcacacaccacacataccacacacactctacataatacgtcacacataccacacaacacacacacttccacacaatataccacatacacaccgcacatacaccatactcacatgtgccacacacataccccacatgatatatcacataaacacacacacacttaatttggcatagtcagcaagataagtgagtacagtacctgcacgtgaaattggcatttggaagccccgggatgctcctggggacggaggactgcggggagaagacaatgtgactggggagcaccggccattggggaggagatggtgcgaccggggagaaccaggagtgtttggagggacaccccaagaaacgggtttccatgccctgtgtgatagcaaaggtgctccttagacccatcctgtgctcaatctaggactggagtgccagaaaccagacctaaaggcattggaagggaaatacagagatcctagcacaaggagtgaacagtgaggggaagaaggagcctccgaataggcctggagactggaattgccagcgttacacatttctaaattgtttttctgatgctctctctaagaggggaggcactatcactcttggataaaggcacagtgttacaatgtccttctgatggcacacttgcccaccttagctttaacctcacagaaggtgtgcttctgccaattgctatgcattgaccagcagtcatagtggagctgacaccaaggagctgttttctttgcctctgattccttctcaaaattgcaccaaatatttgccatggcttctggctggaagtaggaatgttgttctgaacaatattatggggtggcggtgagatggacttgagaggcatcccggactcatgactcatctctttccctgcatccccagaatcctgtcacattactcttaatggtccagaaaatacaaggactcctcgaaggatgaaagaagggatttggtgagcagaggaaactataacccacactgtgtgcagtggaggaccagtgagaaagtgtggggggcttatggagtgcttccagcagggaagaggcacgtagaaggagcagagggccctggagccacagcaggcaaacctcttgggaatatgagacaaaatactacacatacgaaaccacatttgttcattctccttgccagcagaattttacgaagcccctgactcagtggctgagtgcagccctccagaagaatgccctgaagatgataagcaggatagagcacaggctgccatctctcttgcctaaatcactacattttaagaaaaagataagttcaatgatcctagcttttgcctcttcttgtacataagacaatgttcaagaggattagagattatgcttctataatctataaccaggtgcacccaaacattgaggagattctgctctaatgtaacttctgagcacatgcaaaacctccactgccagtatagaagctgtgggctgccacattgctttggagcagtctagcagaagttctgtgaaaggctctcctgggttgcaatcctcagtgagacttctgaataaaactaactttaattatcgaaaagcctgatttttttctttcattgacaggaaccagagttgagattgttggctctgtcctccttcacccagcagcaggcaactttgggagcgggcacttgagtaggagtgtgaaggtagccccagaagcactggggacctcccatgcatagaacactaactactggcacactcagcccagtagaattctctccacctccccagccctggagacagccttcactgcttgcaggtaacaaagataatgctcactgaaggatctcagagaaccttaggtcaaagacaggtattcaaacaagacataaacaattgtgaaaaaagtcacaattgaataccagcaccaaggaaatagagttaattgaatgaagagattttatttatttatttatttatttatttatttatttttactttttgagatgaaatctctctctggcgcccaggctggagttcagtggcgcgatctcggctcactgcaacctctgtctcccgggttcaagcgattgtcctacctcagcctcccgagtagctgggattataggcgcagcaccaccatgcccggctaatttttgtatttgcagtagagacggggtttcaccatgttggccaggctggtctcaaactcctgatctcaagtgatctgcctgactcggcctcccaaagtgctgggattacaggcgtgatccactgtgcccagcctgaagaagagattttagaagaaggaaatatctcaagaggaatgaaagtatatcaagaacaagtgattatagaaatgaaataattagatcttggcaatgaaagatatgattgtcaaaataaactaaataacttaatgattaggattagtatcatgataacatacatagagaattagtgatgtagaagaacaaggcaagggatactccagaattcagtgcaaaaagatagaaaggctgctagtggtctaccagattccagtttcctcttctttcagagtacaaggctggactacatgcaggttgatatggccacgtggctaaattctgtccaatgaatgtgagtagggggtctgtgtgctgctgatgaactaagggcgtgccttctccctgctgtcctgcttcccactgcctatagccagctctgcaagcaggtgaggatggcacactagagatgtcagagaaatggaatggagggagatttgagcttgtcaatgtcaaataaaagataaaataaaagattagagatgaatgtctaatgaatgtctaaatttaaaacattttatttggaagcaagaattgcaaattggggcatacacacagagtgggtagtcttaggtctgttcaaagaacaaagaaaagatgggaggttttacaaaaaggataaatgttatgtatcatttgaaagaaagttattttgcattagtaaagttttggagagctggtggctctgactagtgagggatggtggtgggtagagtcacagcagattgttttagtagctgttagataaaactggtttcaggttacaacaggaagcttcagcagttgagcttgtgaaaaatgtaattcttggagcaggtgccatgtgcctcaagtaattttcccccccgggcccttcaatttggatttagtcaggtgtaataggaatggcccaatttgcataatcttctttcttatggctcccttttgatcaagatctttctccaaaaccattgctgatcaaccatactgtcttgggaaaagctgtctatcccatgaaaaacatcaatttctcattctggtgtgcagtttgaatgcctctggttatggcatcaggccttttggtgaactttctgtgtggcacatacatcagtcatgagacatgttccttaaaatttgtctactttcagctttagaaatagaacagttcatgttttggtaattttatgagggaaagttggattagaggaacccagaagaatttaggtctatactagtctataggtaaatagcaagaactcaaacacaatgtagagttatcatttattaagaggcatattataactttactttagaaacacaggttttaaaatttttaacattgatcacgtaagaacctcagatttaaaactttgagactgggaagccaaactgaggcagactttagattttgcttacagttttaaggttcctgtgccaggaaatgacaattttaatgtactcattgtaaggctggtaacccttgaagtcaggcattttgtgcattcttcaaatatgacattttagtcaaagccttggtaatataatcaattatattctgctatagaaagagaatggattttttttttttttttttttttttttttttttttttttagatgtggtctcgctctgtctcccaggctcactctcccaggaatgcagtggcatgatcttggctcactgcaatctctgcctctcaggttcaatcaattcctgtgcctcagcctcccgagtagctgggattacaagtgtgaaccacaatgatcagctaatttttgtatttttttttagtatagatggagttttgccatgttggccaggtgggtcttgagctcctgacctcaggtgatccgcccgccttggcctcccaaagtgctgggattacaggcacgagccattgtgccccgctgaagagaatggattttcattgcacttaggcaaataatcatattgccataagaatactcacaaatagtttttgaattctggaagaatcaagtaaggagaaaacaccaaatgcttttatctttgtttaaaaaagtatactttatcaaattgctgtaaattatagataaagagaaattttttccttaaatctggagaacaaaatatttaagacaagaatcaacaatgttttaaataaaagttataaaaatattatttttttttgagatagagtctcgtttggtcacccaggctgaagtgcagtggcatgatctcagctcattataacctccgcctcctgggttcaaactattctcctgcctcagcctcctgagtaactggaattacaggtgctcaccaccactgttcctctgttgcccaggccagagtgcagtggcacgatctcagctcactgcaagctctgcctcctgggttcacaccattctcctgcctcagcctcccaaataggtgggactacaggtgcccaccaccacgcctggctaattttttgtatttttagtagagatggggtttcactgtgttagccaggatggtcttgatctcctgacgtcgtgatccacccatctcggcctcccaaagtgctgggcgtgagccaccatgcctggccaaaaatatctttatcaattacttaattcatgtaattaatttttgtcctgattgatcttgattactagtttcatgaacccatcaatttatttagtagagatctggacatttttatttagtctattgatcttaaagttaacagaaacctgtatttaagagtatttattagaatcttttccattaatctgattgtaaatgtttttagagaagaattcaaaactgtggatgacaaaaacttagaatagccatagttaaaaatctgacgaaagtttataatcaacaaggaaatttcgttatttctattatatatagcattttaagataaccagaattatgactaagacatatttctataaatttgtttatacttttttctttttttctcatctgatatttttataaatttacagaattttcagaactttcatatcaacaacataccaataaatgcaactaaaagaagatctagtatcacttatcatttgacaatgttttttgtatgatttaccaaataacagtaatcatttaatatccccatctacaagatgagaggtatatctcttgagactttccagggaccaaattagaaaaatcccaaggttaattctaggtcatgaagacttaggttaggatttgattttggggaagtttgtcaatgatgtaaaaaacttaaaatatttgattgaaacagaatcacagatcactgaaaaataatagtcattcacttaactaaagcgatagttgaggtttcagaagcaatatagaaagttacatggatgtaaacaccttaacctttttcaatatcagtttttctaagtaatcaaaaacctaataaagacaacacaataaattatcttgataaaatggttttttttttttttggctcagtaaccaaaaagttaaaaagaaaatctgcagaatgactgtttctccttaccagaatctcactaatataacctggaagttgaacctaatgaaaaatatacttgattttaatcctacacaggaagaatatgtccaagattgtgagtatacactatattatagaagaatgtaaacaagaaaactagtaccttgagaaagaaaatacatggctcttagtaacagcatggaaaagcttcctggttacatggtacaattcagacatattgagaaaagccaagagtatagaatcaaattatactggaggaaaacattgcttttctaggcttttaagagaaacacttcagcatcagaccataatagcagaggtagaactggcgggaaaaaaaaaagatgtaagagttgacaaaaaaggttgaaggagagaattatcaccccagccaagcaaaaaatacaccttttcaaggggagaaagttcagaaggcaaggatcttttgctgcaagtcatgtgctgcaaggtacagcagaagttgaacttctgagacaaaaatttgagaaatttcaaaaggaaaactttacctcaaggaatgaattaccattgtaaataaagaggaccatatttttaagccaaaactagggaaattaattagatctcaggaaatgtggcagatactgacactggctgcagtttagaagattgttgttaaaaaaaaacagattttagaattaaaaataaaacccttttgcaattttattaagagcagaccaatacttcaaaaaaactttgttgttctaaatagggggccacatttttttggtttagtattagtgtatttttagtatcaaattttaatctttagaaacatttataaataattcccttctaattataaacaacttgatcatacacaaaatttatttcataacttccccctttatgaacctttttatgacttacttggaccatagttgacatacttgttttttttgcttttttctatacatcctgtttcttaaataactagtcgttttgctttaggacaacaatttaccacataagagtctttctcaaataaattatttttttcatattacttatattttgattaataaacctaaatatatttagtattattataaaattgaagaagccaagaacaaacttatatttatttagcaatttgttggttttttcttatttggatatgaaccggacatttaatgagtacctattatttaatttaccataactttaagattttagattacatgaaaagtttatttataaatgtttattctatttatagtcacctaatctttttaacaattatatctagagtttatatgtataatcatctaattttttttaacaactatatctagagtttactatgaaaattgaggtattagagctagtcattaagttcttttattagccaacttggtagcctgttaatatcaagtgtttacctaagtaagagccttaaagttaaataaatgggtatttggttgataactcacaagctatagctgtttttattgaatcaacaatattaaaataatcttacttatcaaagaattgcacaaaaatcattctgttttaggctgggttcacagctttataaccttaaaggatctaacagaagcaaataaactgtctaatcagttcacccaggcaaaaaatatatgttgacaattttgggacatttctaattttatgttatcaacaattttgaagccaattaatatatccaatatttacttaagtcatgtgaacgaaaaaaatttttgttcattgctgtatattttatatgagtgctcatttatctaaatagaattctttaaggaatttttggccagctatgccagattttgccatgtagacacaacataaaacacaatacatgtacatatgtgtaaacacatctaaacacatatacacacacaccaagatcttacagcatcagcagtaagcaaataactgtggaaatgactttaaataggcgtagttaaaaacagaattgacaagaaaatttggttatttctgtggtttacaataacttaacataataactatgattgatagcatatactcagacatattagaattttagaaaccccatataattttggaacatatattaatatcattcactaaaatatagcctgaagaaggttaaacattagtttttattttgacaatgcttctcatgtaacttaacatgtcaaataatcctgttaacctctcttttggatgcttcaggggccctctgtagcacctcaaagttagaggtcagaaaagacaattttgaagctgaaatttgattttgggaagcttatcaaatatgttattaaggtttaaaacacttaatattatgaaatagaatcccaggtcaacataagtcattcatttagccaaaatgatgactcaaaaatataaaaggcataaacctttactcattgatggagggaagacttagctttccaaacaatctgtctcgtctttcccttctttttttggtagtttattcaaaaggcaaacaaaaatgtttcatttttaaaaatatagcataaaaatcttgttcaagagagaaagccaattttagcattgcattagtgcattattgatgtcaaaccccattcttaataaaaccttatagacaaatatgttcaattttaatgtctgactataagataagattctcataagtcttttttataaccctttaccatttttgttaaagagcagatcagtgctctaaggaaactgttgtggttttattccaatgttcaatttacagaaaaaactgagtaatacccctttaaatttagccaatatgttcatacatagaatctctgttacaattaatttttcacaactgtttcacaacttgttcaaacctttagctttatcctaatttaaaacaatactttaaccctctaaactaggcaaaaatttacatttccatgccttgttataatcttttagtaaaagcacattttgctttcctcatacactttgcatgtacaactttttttagtagtcttaattacatgttacaatgttaattcttagcaatattaatttttggtgaaaaccctgttaagtaagtgattttaattacgtactaggtttggagcctaggacaccagacagaagtacagataaggtctgacccttttcagcatagctaggggagtggttaattccacatgtccttaggtctgacctagctgttaagcaggcaagttgaacaattttcaaaagccaaagaagcagtttatgaccttaaagcatttagtaaacctaatatctgacctacctaatttatttacttattttattttattattattttttttgagatggagtcttgctctgccgcccaggctggagtgcagtgttgcgatcctggctcactgcaacctccacctcccgggctcaagcaattctcctgcctcagcctcctgagtagctgggattacaagcatgtgccaccatgtccggctaatttttgtatttttagtagagatggggctttaccgcgttggccaggctggtcttgaactcctgactccagggatctgcctgccttggcttcccaaagtgctgtgattatgagcatgagccactgcacccagcctgacctacctaatttagaccaaatgtctttattttaccagtaatctttaaaactgtttttatttctcagagattactaaagtcacgtgaactacaaggcattacagttttttctttcaaaatattttatttaagccttatttttctttaagccaattacttagagttcatttatataaacatcacacacacgacacatatataactacacagatagaaaaagatccactagttgtaagatttttcatttgccagtttttaagtttcttaattagattactggcttcagggtggggtccttcaaggagcagggccaggaaaggatgcggtttctaggacctaataaggaggcacaactgaatgacaaaaacagatctccaaaattaagggtcccatttttatattacatcccagatccctaaaaagaggaaaatgctatagaagacagtgcaatgcttttaccatgcatttaattgcatggcaacccaaagccaatcagcccattttgcaatcagcctgtcccccgtgagagtcaattaatttgactcctagtagggggtggggatttttccgtaccttctaggtggccaagagcatgcttctctgattcaagcatggttagtatccccccataactgccattaaccatctctaaaagtatatttcctacctagttattacacacgaaagttctcttataatgcaagtaatttttgatacccccaaaactgaaaaccttcagataacacaatgcaaaatctatttactttcaattcctggggtttcatgaggaaaatcgagattttttcccaaaaccgggtctatggcacttcctctgtttttcctaaggagtcccagactattggaagttatcttaggtcttctcatgtgtgcattaagtgtggcaagaagacaaaatggagaaaaacaattcagttgactgagaagaaaaaacaaacaaacctattttcttcagaaaaataagatccaagaagggaataaaaacccataaaggccatttaaatatacatatagcttggatatatgtatccaagtcagctttaattaaactgacttttaaccacagcactcacaaaaatgttcttttaatttctcattactctagtttagccagggcaaacagccaatatatctggcttttaaactttaccgtaagtaactctacgagtgaaaccaacaaacctcaactaaggttatgacttaaccatgagtgtatgaggtattttcaatttttacaaaattaagaatcttcaaaggtagctcagagaaaggaaaatttaagaagggaagccagaagttgttaatggaggggaagggaatcaacaaacggtaaaggtcacagagatgtccaccagaatgtactcattctgtaagctaggatagaacccaggctgccattataaaatggcaaacccttagctgctgagctaaaacattgggcagtttccactgcttttcccacaaagagtctagagcaatcaattttgagcttgcaatggcttttaactactcaaaataatttttagagctaactatgatatgagccccaaaattccttttccctagatggcagagaccaagagaaagtactgccacactgttacaaggtcaagctcccaaggacataaaacaagatggagacctcattcagttttctgcttgtttcaggaatctgtagcaaagtttgtaaccataggcaaaagcctctcaattttgcaagttgccacccaactagctgcatggaggacccaaattaatgttttccattctggccagagaaaaatacatgtgacaaaacatagacattagccactctgcttagcacccactatcgaacttgtgaggctcaaacttgcccccagttggtccctatcatctttaatacattcaaagtggattaaaggagtttcaacatgtgatctttgggcaagatggacgcccttttaacagaaaagaaagggaaagaagagaaagggagaaaagcattgcctgtggcagagtggggaagatgaggagctcagggaggccagagaaagacccacccattgcagggatgctgaatcaaaagttcaggcggctgattgttggtcgtgaaggatcttttcgagcagtcccatcagctcccaaattttcccctttggggagaaaaagttccccacgttctatggcctggtacacgcctaatcctatcacccactggtgttagcaaagagtgcaaggcagatcactccaaagagaatagtggttaaccccatggtgccaaatccacgtttaacaaagagggactttactgagggggaaggcctccaacccaatcccatcctttaccaggtaaaatgaacccactactcacccaaagtcagcccattggtgctgcggtctatttcctttggatcgggatcgtaactaagctaaaaggctagcagatttaattttttaagtcaatgagtcgcataagctttcgatttgccttttgtaaagtctttaaataaaaatactgaaatctttttagaagcttctgcatatcaatagacatccctagatgagactaacttgggagccctcattttcaaatgcacttcagtgcagttttgttcatttggaacattccactctaagttatctttagtaagatttcaccatttctataagactgctgcttccggggcctaccacttatgcaggtattagccagaaggaactcagttcttcagaaattaaggatccaggccgggcgcggtggctcatgcttgtaatcccagcactttgggaggcgaggtgggtggatcacgaggtcaggagatcgagaccatcctggctaacacggtgaaaccccgtctctactaaaaatacaaaaaaaattagccgggcgtggtggcgggtgcttgtagtcccagctacttgggaggctgaggcaggagaatggcgtgaacccgggaggcggagcttgcagtgagccgagatcacgccactgcacttcagcctgggcgacagagcgagactccgtctcaaattaaagaaaaaaaagaaattaaggattcaatttttacctcagattttggctttgctctcaggttcctttgatcaacctagccaatgatttttctcctaccaaagtgcataagaaaaatgaaacaaggccgggtgcagtggctcacacttgttatcccagctctttgggaggccgaggcgggtggatcacctgaggtcaggagttcaagaccagcctggccaacatggtgaaaccccatctctactaaaaatacaaaaaattagcagggcgtggtggtagacgcctgtaatcccagctcctcaggaggctgaggcaggagaatcacttgaatctgggaggcagagagtgcagtgagctgagattgcgccactgcactccagcctgggcaacaaggtgagactgtctcaaaaaaaaaaaaaaaaaaagaaaaagaaacaaaggggtaaaacacaaaaatccctgtgaattttcaatagcctaattttacacccctgcaatattaccatttactacgtttctttctgacccagtcagatgtaagaggcctctaactgtatccaagccagttaattaccagatcaaatccattccttgaaccagcccagtttctgtcatgacttccaaacccagtttggaacagaaatttgctcaaagaaactcggagagctcaaaacacaaatcagtggagctctgacattggagagaaaacttaccatgacttccaactgctctgagagatcaacgaacacaaataggtcctgcaggtacctggcttcagtcactcagcactcctgggagtcgttagaagctctacttcagatctgctctgacaccatctgataaaagaaaaacttcagctgaattaaatttaaaggagcttaagtgagcaggcaatgaatgattcgcgaactgggcagccttctgagccagagtaggctcagagactccagcacagccacgtgatggaggaagatttatggacagagaaaggaaagtgaggtacagaaaacggaggtgaggtacagaaatagctgattggttacagcttggtgttcaccttatttgaacagggttcaaacagttggctacatttgattggccaaaactcattgattagcacaagtgtagactacagtctgtttacacctccacttgttatagttcatgatgtacagaaaaacctttaggctgaacttaaaatatgtaaggaggcagatttaggctaaattgatttattttttattatatttttaagacggagtctcactctgtcactcaggctggagtgcagtggcgtgatctcggctcatcacaacctccatctcctgggtttaagcgattctcctgcctcagcctcccaagtaggtgggactacaggtgtgtgccaccattcctggctattttttgtatttttagtagagatggggtttcaccatgttggccaagctggtttcaaactcctggcctcaggtaatccacctgccttagcctcccaaagtgctgggattagaggtgtgagccaccgcacccggccggctaaacttgatttaacagtacctttggggagataatttttttgtataatggaatagttactctaattataagctgctattatacctcatttggatctgggaattttctcatgtgatgtatgtacacacacacacacacacacacacgactaatattgcaatattcttttttgtctatgtttgtgtgtccttgtagaactttctatagcccagtctggaagtgtagggaaactgtatctgtttcagagtgaaactgctctaggggatgggaaattttgagtttattatttccatgagaaaatggaatggggcttcttttgggggaagatttaaaattatctgtggaaaaaagtgagttggacttggtaatgtaagatgagaaatttttcattattatattcaatgagatagacacaaatactggtttccttaatatttctgaaattgtatcattgactatgatagatgagactactgttcaaacatattcactcttctacctctccatttcactggaagagtgtagttactggttctattaatgttgggcatggctctgacttgctttggcctcagggtaggtgggggacagttctttgcctctcgactgtgctcagccatgtagcttgctttggtcaatggatgttagcagatgtgactcacggaggaatggaaattaccttgcatagctgggcttgtcctcttgaactgctgccatctccatgcataacacttctttgaactccttcagcctgagccccagatggaatatcagtggagaagtttaaatctcagtgaggagccaagtccagttggactcatagcttgaaacagagctgccccattgagctcgcctaggtcagctagccccagctgacctgcagtcatgtcaattgtatgtcactaagattttgtggctcttttttactcagctttagctaactaatatatcaccatatcagggaattttggtaggacaacatagctaagcacaatttgagatggggaatagaatagggtaaattctctgttcaaagcatatggtaatctggtgcctattttacttattatcccatttgtgcccttttttataacatgtctttggaagcgaaactgtacatccagtgtctctgtaacactgagtctattgtccatgtaacattcagtctactgaactgctttaaaatattagttgaatgacagtagactgaacgaatctctgtagttccagaaggcagggagaaggattgggagagtcgacacaaagtgtgcagccagggctgcgttggtatttttcctctgatgtgctccacagaatggcagctgacccactgtgggttgataatttcactggttcacagaagacagggaatataggactttagggaaataatgtgcctttgtctttgtctttctcttattctctatcaagggggaaaatgctgctctgggctggttggattcaagctcatggattggaccatgggataaagttttagtggcagatggctacttccttgaaatagagtggagaaaaagggtggcagcattggtgagaagggacaggcaggaggcagtagggaagtccagctttactctggagagaagaagaggtgggggtggggagggcagggccagctgtttggggtgggaggcagggaaggtgttggctgcccagttgacatctcttatctctttcctggggccagagtaggttattttacagcccagcctctttatggcctcagcagagaagcaaaggcaaacaaagaacaggtgatccctcagggcccaaggagacgcctcctacagcaggtgtgcccacttcagcagccctgctggccagaatctctacttagaaggcttctcggaaggccaggcccttatcggcttccgactttgaagtcctaggaaccctccctcacacctcccttctatgtggctttgaaaatactttgatattctatccctatcccttaattatttgaaccctcaccagtttgtaatgagcctgaacccatctttgctccattttacatatgacaaaactgaggctggaagcgttgttgccaagcttctttgccctttgtaccatgggatttaattacatatattttatggattctttcctttataaagttgtaatcattcattcttttttaatagagagaaatttagaaaaggaaacaaagcaaaaaatgacctaaaatcctatgggtcagataactcccgttgatattctttccttctttcccccagttctatttccagaggttaccactttcaatttttatttctgtttcattctataaagatgaagaaaatttttgacacctttaaaaatataatttaaatcatcttaaacttatagaaaagttgaaagtgaggataaagaacattaatttttctacgccatttgagagcatgatcccggcaatttgcatgaacaccttgctaccgcctcatctgcaggctccactaaagtttcatcagctgtcccaagatacacaggtttcattctcctgtctctggtctccttcaatctggaatggttctcccttctttccttgacttccatggccttatgtttccagatgacaggccagttattctgtagtgtgtccctcacctgggttgaggctgatgcttcttcagggttggattcacttgcatgcaccttcagcaggaagatcacagaagctgtgctgcgttttccttgcatcctgtcatgtggtgagtaatttcactctaggattagagatggtgttcgctatgatcatttgattacagaggtgactgccagccttctccactgtaaggtgactcttctctttgtaataaacaaatattttgtgatgaggcacactgaaaccatgaatatattccattcctcatcaaactgtcactttactccatcatttagttatattgaaatggactcagatttttattttattcagtaggttattatccatcatcattattatttactttgatgctcacatggtcgaagatttggccatcaagggccccttcaagccaggttctgggcttttctggcctgcacccttcattcttagagtacttcattactttctagctcccaagatctttcaggtttatcttgggctttcccagcccttgccctggaatcagccattttccgaaggagacttggattcttttaatggagaatggcatttagaagtcaatatatgggtgctaggagtgttcattgctattggggtatcactgctcctagactctctcagtggacagagcaaggatatatatgcacacacactattagatcaatatttatctctctatatagaaaaccatgagctcacttcaatactttcaattctaatcaaaaccacagggcttattctgggtttccctccttccatattcatgactgccttctccatgagtgagaaaactggctcccaactttgctcagttggtccccctgcatatacccaatcttccatagcagaactctgcccctccactcattctgtgtggctctgacatccacacttggttgtccccttctgccatgtggactttcatttgacagtacttggactctaacaccctgtgctaggccaccgtgcccctgcctccctgcatggccactctttgtcctattctggctctgacatgccatgccaggctcccccacgccagatgggtgccatctggtacatatcccgtgtgcttagcttagactacccgggctatgatggctactgtcccacccatgcccatgtgctgcatgcatcttatgaaggcatctggtttattctccctgctcatcagttcaatcagcatgtgctaccagtgtagtgcaccagcataccatctgtggatctgtgggatgttcagaagatcaaggtctctgtagaccacactataacagaaagctggaaaacgaacatgatctgggagaagacactgactttgtacttctatccttgccaggtgaaagcaaacttctgctggttcttaccgatatagatggggagaaaacacaagctgagtcaatagctacatattaagtgctgagagtggttaagttgttctatgttgcatttagaaaagcagctaaaattggagttactgcctgattaaatttacgacgacatacagtcattctccaagattcagcaacttcctgcacaggctaaagagctaaagaggtgagccaagtgggcagaaatgtgacaggcctccctgtccctgcatctttcatgtctttaatcatggcatcgatccctgtaattcccctagaaatacagaaatgcaggtttactatttgcgtagggaaagaaaatcccaggctcctgggcctgttcaaccatttctttgacctcatctctccttgcttgattttataccagttgtgctggagtaccttctaatatggtttggctctgtgtccccacccaaatctcatctctaattgtcatctccacatgccgagggaggtacctggtgggaggtaatcggattatgggggcagtttacctcatgctgttctcatgatggtaagtttccacgagatctgatggtttaaaagtgtttgggagtccctagcctctctcctgccgccatgtaagatgtaccttgcttccccctctgccatggttgtaagttttctgaggcctccccagccatgtggaactgcgagtcaattaaagctgttttgtttataaatcacccagtcttaggtagttctttatagcagtgtgaaaatggactaatacacttccttaatgaactctctcagaaaggattcaggaaatgtaagcttgcaagtttagaaatatccttattctacctttacacttgatattatcgctgagataagcgttttaggttcaaaatatatttccaggagtcctaaaaatatagctccatcttttcagagtcttccatcatcctatgttgttgacaagactgagaatggtctctgtctctcctttcctttgtaggcaacctttctcttcctgctcccacccatggaacattttagaatcttcttttttttttttttttttttttttttggtgttttgaaattttgcagtacctgtctaggtgtggagcagttccccgggcttccttttaatctgtagctctggaatactcttgctattgatgattctatgtgtcgactattttgctcacaccccacccagatgcattctctactgtggttctctgctcttccctgtgccaggggaagctgatggctcctttgctggcagggctccagttgggtttggtcaatgggagggactgacaggagactggaagtggaaggagagagaggttggtagaattcttttctacttccccttgcttccatgctgtctggaggcggtggcatgcctccacactacagaagctcccactgggggcccttcctctgcagtcctctggctgtggtaatgtggttttctccttttgttcttttaactgtagggtggtgattgcttctgtcttctgccagtctctgggtgcctcaccatttcttgtttctttcctttaacgcttcccacacctctgtaagttacctttttattaaaatccctttgtttgacaatctgggggtgaattatgtgtcctgtgcagactatgactgatatgctgcctttcattgtcttgatttttccttcctggaaattttagtaattggatgatgggtcattagtgttaatcatccatgtctcttattttagctctgaagttttccatctttctgtgtttttgctctacattatgggatatttcctaagctggttctcccatcccttctaatgatgtgttttcaaatttcagtagtcatgcttagttttcaaggattctttcttgctttcttagtctgtcttatttcacggcaatctgctcttgttatatggattcagtaatttctctaatttaggcattaaaggaagttttggtctcttaaagttattttctattccctaagttatttcagcttcttttggggtcagttattttgtttattcatcttgacctatctcctttgtgctgttgattttctaaatgtgtgaggatctttggttctctgttataagtactggaaaataaactggtttccccggatagctgatgtggcttccctctgctatagccttccatgaaaaaagtaggacagcttccgggagctagctatatgtgagtggaccatgcttggcagctgcccttcagaatgcacaggttgcgggcagggatggccaaggacatttctcagggagctgtgtgtatgggatgggtctctgagaatggagagcttgatgagttcaggccgtggaagcaacatctacacaagcctggatctgagaaactcaaccatactccctgaaaatggagagtttacatgcagaatgagtctgggggaggcagcactagaagggctgaaagaggaagagagtcagactgatttcagagggacccatcctagagggaccactgccatgactccatggggacatttccaaggggagccacaggaggtttcactggagagttgtgtatgtctgtccagtgtctaggaggtgctcaccatggctgagcttgcagggcctcttaggactgtccaggtgagatgtgtgggtcgtgatgagggtttggagaggtttccagctagaattggtcgggacagcccattagctctggggcagaggctcagggaggtgggcaagcatgcaggacacaggaatgcttatagccacagctctgcagggtgtttcttgcccataactgtgtggagagccattctcatctcaactcatttcttgccacaacatctcccgaagcaaactttgttattagctccgctttgcagatgagaatctggggcaatgcgagacggcttctgtgcccggcttgtgaccagtcaccacactgactctcaatgtggtgtaagcaactgtgaatgggcctgattccaaatcccagcaaatttacagtaaggagggtgcctggggtctatccatcccctgactagctgatcttcagcttcctcataggaccagggggaatactgagcatgcagtggactgaggttcagagaggtaatgtggagcgctgcacacacctgagggagttgtgcgcctgtctgacttccgggtgattcatgaggaacattcctgatggggtgggaagggaacctgtcactaagctatttaggagaatcagtctccagcaggtcacaccagccagccacttttatggcagaaggaaaatcctacctagccccttccccagagatggcagaatgcagcctggctgactggcagagcctctcaggctgtgctccggaccctggactccagcaagggggaagaacagcagctcccagttctttcttacagactgctttcttgaggagcttcaagtgctctggctatgattggtgcagggctctgctgcctccagagggtgctgtctcctttccctagcagaggcaaagggtctggcaggcaactctgggagtattggtttaacctgaaatgtctgctaggaagagctacctacccctctcctgggcattatggtcctgaaggaagagcttggactttggattgaaagtccagccctaccatctacaagttggctggctgagacaagacactctacttctttgaggctcagttttctcgcctgtgagatgggatgatcacaccacaccagttaggcatgaggatggactaagggcaggttcacatgcttctgcctggcatgggagctgtttgctgcttttaccaccatttcagctcttctgctgttctctgacccacaagagctagggttcaggctgcgtgccttgcgcagtagttctcaaatgtgtctatgtggaagcttgcctccaagggcttaccagcaaatccagaccccacacagctgccctgcaagaaggaggtgacagtggctgcgttcttgcctgcacagaggacgggtgtccatagagctcccagctggagttgagcagtttctggtcaagcaatgttctctgattttacatgtctggaagctaccattacaatcaggtcttcttaaatgtcctccctccctccgtcttcctttcttcctttctttctttgtcagatgctgtgtgtggacttgtgctgggatctggaggcggagacaagagctgtgacctagacataggggagtggggaacaaaggtgctcaggcagacaaccaactaggctgctacatctgcctctgcagcagagcatgggagggtggtaggaatttgtcatggcagcagggacatcggagctggggtgcaacagaggagcagccgctttccaggtagtcaagacaggaagcagcatggtccagaaagaagagatgacaggtgccagtctacagcgatggtgagcagaggcctgggggcttggcaggtgggttcgcatcctggatctggctgtttcttagctgagtgactttgggcaagttgctcaaccactgagtgtcactttgcttcatcagcacgatgggaataaaaatgcccacctctcagagctgttgtgatgattaactaaggtagtgtctgcagagtctatgcactacaaacggcagctgccattctagagggaccactgccatgacttcatggggacatttccatggggagccacaggaggttcactggacaggtgtgtatgtccagtgtttaggaggtgctcttgaagcagatctgttactctcaggaggttctctaagcacatatgtgactttgccatgtggggatggggggcagggaattataagctagtgtattcaaaacaggagcagcccttgtaagcaaagctgttccattatagccaagtcatgtgcatctcagctccaaaggagaaagtgaccattctcattgaattctcatcgccacaaccttgggactgcctgagataagacactccacttccagggcccaccctgagttttcactcacaccctggatgcccatctccttccctcaccctggctgacattctcagccacactgccctcccctggtctccaggggctgaatgctcccagcctcagggcttttgccgtggctgtgccatccatctggcctatcgaacccatttgctcacagcatctcaccccctgtaataatttatttccctctttccttgtaccctgtctgtcttctcccccagggctgagagctccagaaggaaccaaggacagggagcctgtcttgtccagctctggtgcccagcaggagagccaggctcataggaggtctgcaagtaatgtttctggacgaacttatgaaaggcaggtctttttatacccatttcatggatgaggaaactgaggcagagagagagagagacaggcagacgcacacacccctagacagagagaaacactcctggagaaagagaaagggagggagagagggagggggagggagggagagagagagagagagagagagagaaagaaagaaagaaagaaagaaagaaagaaagaaagaaagaaagaaagaaagaaagagagagagaaagacagcgcagctccagcctgcctgtatccagggttgaggtgggcgtgagagacacacgcaggcagggctgcagttccgggcaggccttgggggctcaagatgcggctccccagggcgagtgctggggtcccggggcaggcgggcggctggagcgctctcgtgggcgggcgcaaggggcaggctgggcgggcgcaggcgggagcgtagcagccgctccactccgcacgcaggcagcatcggggcagcaggagcaggtgaagcaggcgcggctctgccccgcgcctggtgccccctgggcacaggagtgcggccgggggcggggccgagtgggccccggtacgaaccctccgggaagccgggcgcgctgcctgcccttggcccggggcgcagagcgtcacactggatctggggagcatcctacccccactgtggacctcagtctcctcacctgagacatgggcggccccatccgcaccctgtaagccgcaagccaaggaggtaaggggtgcatctgaggtgtctgggcgctatgggcattaggatatagtagcttttgctgagatttcaggagacaaagcaaagggccttccctattctaaccccactgggagattagcattttgtgtatgattcattaattttcctctgattgactgggaaggcaggctgcagggggtccctgttggggcttgcagctggttctagtttttgtatctggagagctgcctggggacaaaatgcagagacaccattttattgaccttgcgtaataatctaccctccccctcatacactcgccacccccttgggtgtgcctgagggacttgaggtcccctggtcctcactggtcagtgtaccccaagcccagcagccccaggcagatgcccaacaccaccttttcagtgctcctcctcctcctgtcttggccctctctgccaatccattttctatatccaagtgatcttactggaatggacctgaccttgctggtctggcccaccactccagcttcatcatctgccaccctggaacctcttattctgcttacttttcccagcaggctctgctccttcctgcctctgtgcctttgcacatgctgttccttgcacttcgagttccctcctctccctgtccctttggctggttgactcctcttcagcctttgagccctgtaccattgccacctcttctctcacctccctgctccctgctccttctctgatctctcaactcacaggcctctctttcatattggtgttggcaatggcaatgagttccatctgcattcgtgctggtcagcccctctgctctgggagggccatgactgtataagtcatctttgcagcccttgtttctagcccagggcttgacacacacttattgagtgggtgaatgaagcagtgagcattttctggagccctcccagcccagtccttccactctgatcctgctttaggtggttggtttgggatgaatggtgtttctccacaccactggccaagccttgctgatggtcacccagagccttgggttctggcccatttgctgcttctgagtgcagtgcctctgccacaggttcatgcagctgggactgctctttatcttatattgggccctgtgtttggctctggaatagtttattttgccatgttcagccccaaatggccctttttgccagaagaccatagtgctggagaaatcttcctgccttcgagatctggttcctaaataaccagactgtaaactatcaggtgaattcacagcttgatcttttaaatgaccaaatgagactcttttttttttttttttttgagacagagtctcgctctgttgcccaggctggagtgcagtggtgcactctctgctgactgcaacctccgcctcccaggttcaagtgattctcctgcttcagcctcccatgtagctgggactacaggcatgcaccaccacacttggctaatttttgtattttcagcggagacggggtttcaccatgttgaccaggcaggtgttgaagtcctgacctcagaaactcatctttataagtagatcagatgcacagcgagtgacattcatgacagccgacaaatagagtttactgagctctggttgattttggccttgtgctctgcaaaaactgccttaacatagcaattgatcatgtaaaaaatacatatggccatgatatgagacttaaagaatatctcgaatagggttttctgctatagtgttttacaagatggggtccaagggccatgtgcatcagaatcacatagtctacttgttaaatacagattcctggcccccatcctggattcacttaactacatctcctggtggaagggccctgggatctgcactttcaacatgcttctagaatgattctgatgtttactgaaggttgagaactgcaaccctgtgggattaataatgactagagaatctgagaggtgagtcacaatgatgtatgtagtggtatggtgcttcccatgcaaaacatccatcattggcactaacacgggggaactctggagtctaaattccaactcagtcttggcagggggtccgttgtgctgaggaggtcctcggagaagggacagcctgtaccagggcatagagatgtggaagagtctggtgtgcttgtgagctgcacactgcatcaagtgacttgaacatagtcatggagtaggttctgtggagggcactgggcacctgtgactttggccaggtatgtctgtgcacatggtgggtagtaggaagaagctggtgtgctgatgagccaggctttgcatactgggcagtcttcagttttgccaggtatcacctaaaaaacaaggctaccagggcagggaggggctgagaccaggagggtgcactgattgtggatccccgaggctttagctctatcttgaagggaatggggtgccgtggaaggacacaagcaatcctgtgcagagtggcatttattgctgtctccattcagataaaatgtgacaaggggcattctacccatgttccctgaacaattccgtcactaaagtctgcatacagcactccaacttttttatcatcagaacagcctcatcctgaggccggagggaattagtagaacaagttctggcattagatgacctgagtttgtaactgggccctgttactaattagctgtgtgactatgggcaagttgctttccatctcagggtcttagattcctcatctatgaaacggattgataatatctacctctaggaataaactagctaatagacgaaagtgctgagcacagtacccagcatgcaacaagtgcttctaacaaggtagcaatcattggatgccaatgtctcaccatgagccttaggtaatagcccctccagataccagccttgggttggaagcagctgagagcctttctacccggccctgctcctctctggattctaccctgggcatgatccctgagtattgtttgtctgtttgccttgtaggcgtcatccctcaagtgtatcacttagttcaagagtcctggaatcttttcacatccactatgaacacctctcacctcctggccttgctgctcccaaaatctccacaaggtgaaaacagaagcaaacccctgggcaccccatacaacttctctgaacattgccaggattccgtggacgtgatggtcttcatcgtcacttcctacagcattgagactgtcgtgggggtcctgggtaacctctgcctgatgtgtgtgactgtgaggcagaaggagaaagccaacgtgaccaacctgcttatcgccaacctggccttctctgacttcctcatgtgcctcctctgccagccgctgaccgccgtctacaccatcatggactactggatctttggagagaccctctgcaagatgtcggccttcatccagtgcatgtcggtgacggtctccatcctctcgctcgtcctcgtggccctggagaggcatcagctcatcatcaacccaacaggctggaagcccagcatctcacaggcctacctggggattgtgctcatctgggtcattgcctgtgtcctctccctgcccttcctggccaacagcatcctggagaatgtcttccacaagaaccactccaaggctctggagttcctggcggataaggtggtctgtaccgagtcctggccactggctcaccaccgcaccatctacaccaccttcctgctcctcttccagtactgcctcccactgggcttcatcctggtctgttatgcacgcatctaccggcgcctgcagaggcaggggcgcgtgtttcacaagggcacctacagcttgcgagctgggcacatgaagcaggtcaatgtggtgctggtggtgatggtggtggcctttgctgtgctctggctgcctctgcatgtgttcaacagcctggaagactggcaccatgaggccatccccatctgccacgggaacctcatcttcttagtgtgccacttgcttgccatggcctccacctgcgtcaacccattcatctatggctttctcaacaccaacttcaagaaggagatcaaggccctggtgctgacttgccagcagagcgcccccctggaggagtcggagcatctgcccctgtccacagtacatacggaagtctccaaagggtccctgaggctaagtggcaggtccaatcccatttaaccaggtctaggtcttctccctgccatgtcccttgccaggctcttccacttagctaagtgggcacactgcaagctggggtggcaccccagcattcctggctttctggggtccagataggctggcaagagctgtttttgcatccatttgcatcgtgaagactggcattttgatacttcagctgtttgttcctgggagaattctgagcacagattccagaggtcacagtaagccttgcagcttgagctgaaagatgccagagccggagatgtctgctggcagcaggcagggttcattctggtgacacagcaacagatgcctggcctgggaacccagggatttcacctccaccagtgagaccacggggccactgtggggtgagggaaggagcgcttggagtcagagctctagaccttggtcaactcttcacctctgtgagagatggtgtgtggaggtgcttcagaagtaaagaattctaggccgggcgcggtggctcacgcctgtaatcccagcactttgggaggccgaggcgggcggatcacgaggtcaggagatcgagaccatcccggctaaaacggtgaaaccccgtctctactaaaaatacaaaaaattagccgggcgtagtggcgggcgcctgtagtcccagctacttgggaggctgaggcaggagaatggcgtgaacccgggaggcggagcttgcagtgagccgagatcccgccactgcactccagcctgggcgacagagcaagactccgtctcaaaaaaaaaaaaaaaaaaaaaaaaaaaaaaaaaaaaaaagaattctgtggatgcaaagcagtgggattactgttagatcattagcgcatccagctgaagacaatagatgcagtagtcttggcttacagccctctgcagcaggaattccaggactcacttcctactccatcccttttctctatcactgtgtcttccaccttacatggaaatcagcctgcaagttcctctcctcgatgagatggcaagcgccttgcaggtgaaatccataccatcatggggcttgtgtcttacatgccatggacaggccctggcacaaggagagagctccagggaagttttccatggtgggttgatggtaaaggtgccactcactgctgaatgtttggtgctggacaggagtccagcatgggaagggggccagggctcaggctcctgcagccatagtctcctgcctgcccttccttgcctcccaggacctcatttgatacagtagctggactgagactctgtggctctccccactgttgacccactacagaggcctccagaactcaaggctatggctgcagcctccttcactctgtgctctgaccactgagctgacttgccccagataatgtgccacgtatctttcaaagcttcctcagggtattgggcatcccagtggccttaagtaggatcaggggcagggagtcctgggagtctaacttcatggggcactggctgaaaaaagcaggtgtccccttcctccagccatccagggaaaaaggagaaagggctccaatgagtgtgaatatcttaccttgggggttatggcctagtcctctggatgctgaaccaggcccaaggcttcatctatgtgtggaccagacagcctgtccttacagggaaagaaatgtcaagactgctcctgggctgcattggatgggatgtctccgcatggttctgttggctcagactgaccctccagcagagtggacagtggctggcctactatagcctcccagggcagggtattcatgtgctagagccctggaagagcctcatcataagccagcataggttctgcaaagggggtctggcatagggctctcacccctgaccaagaaccggtggaactgacgcccaagacaagtgctctttgagccagcagctcccttcctggagctgtttgtcttatcgcttcttttggtcacatctcccattcagttcctttgttcatttttgtgttggattttgggcagatttcttgagccattctcttggacacagcttgtgcttgtcctgtggtgccatctgctgctggctgctccaggtgaccacctgccagcgaagcccaggctccgggacccatctattttgtgaaaagcccacatgcacaaagcaacccccaaatgccaaaggagccaagagaccaaagaaggaagcagacaaatccagtttgttggtattgagtgatttattgagggaacttttaagcaggcgggtggtctcgggtggccacaagacaggcagatctctgcactgttactctcggacccaaggcttatataccaagggaaaaggatatacatgctccagcaagacagtgaaaggtagtgtgccagagcaggcaagaacgccatgtgcatcatagcccagaatttgcatgataacatcaagcttgctttgatctaaaagcaggagtacatattcttacactcgggacagtaaataaagtaggagtcaggaggcattcatgggactggggctaatcagaagtcaacatgggaaaattagcatccaagatggagtcacttttgtcttcccatcaccccagaaagatgtcattgttcaagcttcccaaagaattgggggcctcaggccccccctggatcccacgcaagtgcctggagttgcttctcattattagtctcgatggtgccaagatgctggggacaaagatgatttcaggtgcagacatgcttgaggatggagggccaggctaggcctctggggaaagtgtttggtgctaagaattggggtagtgggtagaagcctcgttgagtgtgttctgtgccccagcatcacctggagcttgtagatattcagagtccttgttgccagcccagctcgattgaatccaaatccatgttttatcaggatcccaggttaattgtgtgcacattaaagtttgagaagctctgctctaagaaacaggttgccctggagcctagagacactgggtaagcacctgtagacacccatcctagttctgggaacgtctctaaaattgttattgctgaaaaggtgcattcagttttggttgtctgtctcatctctggctgcatgtggtcatattttttgtgaggctttttcattcttttgataaatatttgccatgtgcatagtttgcatagatatgttcttagtgaacatggctttttgtattctgctctatttcacttaaaactgtatcatcaacagtttttcatcttgctggatatcttttttttttttttttttttttgagaaggagtttcactcatgctgcccaggctggagtgcaatggcacgatcttggctcactacagcttctgcctcccggattcaagcaattctcctgcctcagtctcctgtgtaactgggattacaggtgcctgccaccacacccagctattttttttttttttttttgtatttttagtagagatggggtttcactatattggccaggctggtctcgaactcctgacctcaggtgatccgctctgctctgacttccaaagtgctgggattacaggcatgagccaccgtgcccggcctagatatcatttttgatggccgcttacaagtgtacaaactgccccagtgaaagccagtacccctcagtatctctagctcctgggggtggtggggggggtgggagggcatctctagccagcaagtggaccctctgccacccattgtgggaggaacccaccttacagaggaggatcatggctggaattggagactcataccacaaagactgactgggaacccttggaagatgcaaaactttatcacgtcctggctgtgagtgctaaaaccttgcctaatgctagcctttcttttttaaagtattgatgtggcctttttttttccattataaaagtaatcatattcattctgaaagatatacaatatatacaaaaataaaattgaaaaaaggaaattatcaggagttccaccactcagacataatcactgtttacattttggggagtcattttaaaagttttcatatgcatagtcatatacatatgtctgttttttaaaaaaatggttgagagcatagtgtgtccacatgggaacttataaatcatatttaaggattgttttatatcttttttgtttaacctgatataaatttttattcacttgtttattcattaaacaaatatgtcagacactatgttagctgcggggatacagtggttgtaatcagacattgtccctgttctatgcaacttagagtccattgatagatatatcctatgtccttaatatcatctgttgtggcattctgagctgtctctagacctgttgcatagagttttatgatgaacgtctatgcaaagaaccttttctatatttggaattatttccttaggagagatttccagaagtggaattaacaaagggcatggacagttttcaaggctcttgacgtgtgctgcaaagttgatttccaaaaaaggtctggaacaatttcagggcactccctgaagagtgcccatttcaccgtaccctggccactgttggtgatttaccattaaccaaaagactttgacctgtatcgcccagactggagggtgtcccagctcctgcctccaggtccagcaaacactgtgggcactgaccattcaaggctagcctgaccctgtccctctgtgaaacctttgggggttccacaaagcctttagggttgcaggaccacataacttatccaaacagggatacttgagcatgaaaggggccaccatgaataatcaccctgggacaacaggcaaaactaccctgggaaatgggaacatgagatcatcctactatagataaatctgatccctttaacatagcttaaattcaaccctctccaccatctggccccaacttaccttttcagtctctttgcatcctgacatatcacacgatccagtcacagtcggcctgcaattaccaaccatgccttgggtgtcactgtctctgtacatctgctcccgccattccctcctcctgcctccagccaccccaccccccgccagtctgcaatgcgccccctcgcccatctgtgtaggtccaaatcccacccttgcttcaaaacacaaattaaatggtaccattcaatactgctttcattcaacaaacatgtactgactgcttacgatgtgtcaggcacatagagtacaagaccgaaaacatcccacctcctgtggaactttgatttgtgtgtgcaactgtgacaactggtcctaaagatgaacacaaaatgatgtgccagagagtctgccctgttatggttttgaatagacacacccaccaccccacaaggttatgagctctttgagggtaaaatccaagaggctcatcctccacccttgcaaaacctctgacacacccttggatagagcaggcacttaagcatttgccaagtgaagaattaatattaaagaagcttacctattcactccgcaagagttttctaataaccagttctgggttctccatgaatctgagatcaaaggggagcctaaatttccacataccttagagaaacacccccaggtcctaccactgtgactctctgtccaccctgatactggaagaaactgaagtcaccggattcactgattgctgcttcttgtgaggttaagtgactcatccaaggtcacacagctagatagtgactgagccactggaggggtcaggaggtgatacaggaaagaatcagaatgcatgagtggataagtcaccaaaggagtcactggagtggaggggcctggaggggaaggtgaccctgagtgctggaatggccagagaagaacaaacaagctaacagccccaaagacctccattgtccccagatcccattcactgtcatctcctgaagaacatcactctcacaccatcagtgttctctgctcctttttgcacaaaactcctccagagacttgtctagcctctttctctctctttttttttttttttttttgttcttttagagacagggtcttgctctgtcacccaggctggaatgcagtggcacgaacatagctcactgcaactcgaactcctgggctcaagtgatcatctcacctcagcctcttgaatagctagcaccacaggtgcataccaccatgtccagctaattaaaaaattaaatcttttttttttctttttttgatagagactgggtctccctatgttgtccaggctggttttccttttttcttccttttttgtagagatgaggtctctctctgttgcccaggctggtcttgaactcctggcctcaagtgatccttctgtctcggcctcccaaagtgctaggattggcatgggatactgtgcctggccccctgtctaatcctgaagcttccacttcctctcctcttaggtgctcaccagtccattcatatagctcttgccatgttgccaaatcctgtggccagttctcagtcttgtctgatatggtcgtcagctgtattgggtagttggtcactcccttctccttgagactcctgcatgtggctttttcagggcataatggtcatggttctccctgcctcattgggctcttcttccccatctcttttcttggactcttgttgccctgattttgggacactggagcatccccaaggagccctggaggtcctctcattcccctggtgagctcacccagttttctggtgctaaatgccacaaatactctaatgttccccagtgtatctccagtctgaacttctccctgacctccagatttgggtgtccaggcatgctttgtgtttcctagacaccagtcagcatctcaagcttggcacattcaaaagcaaactccagatttgtccctgctacctccttcctcagtgtcctccttttcagaaaagggcaagtcctgcttttcatttgcttgggccacagtctttgggatcacctcctattcacacccctcatccaatctatcggtgagttctgtaagctgtgccttcaaaatgttctcagaatgaccacttctcactgcctccaggctctgccttcaggttcaagccaccgtcctccctacggagatcatggcagaggcctcctttctggcctcattcagccagagtgatccactgacactagtcaggtgcctctacaactttgttcaaccctccagtggctttccatcatactcagggcaaatttcacagtcacagtctgcacctgtgtctgcagatcatccgcccctctctggcctcacttcccactacccttcccctcacccactcctcttcagcagtgcttgcttctctgctatcttttgaacaggctaagacctctcccgcctcaggcctttctacttcctactcttgctgcttggaatgccaccccttgatatcaactttctcccttgctcccttcaccttaagtgaacctttattagaagattaatttcctggctgggcatggtggtttgtgcctgtaatcccagcactttgggaggccaaagcaggcagatcacttgagcccaggaatttgagaccagtctagacaacacagtgaaaccccatctctctctacaaaaattacaaaaatcagctgggcatggtggcacaagcctgtattctgagctacttgggaggctgaggtgggaggattgactaagcacagaaggtcaaggctgcagtgagccatgatcacaccgttgcacaccagcctgggcaacagagtgaaagcctgtctcaaaaaacagaagactaattttttaaccatcctgtaaaaatataaccatcctccctctctcttcccttttctgcccagtttctgccacaggacttagcacattggctggttctttgttgagggtctccactccctcattagaacatgaaccccatggaagtaggcactgtagatgttttatttactgtccagctctcagcaagaacaggctgttcacgagaggtgcagaagaaatatccatagtacaagtgaatttccaactgttatagttcatcagtggagagctgcacttcagcctcttatttgtggagagcgggcatctggttttgtagctgtttggtcccaagtttgacagccgttgtctgctgactgaaagggagctgaagcagctccctttgcatcctggtttcctggtttgtaataataaacactggctgccatgtatttagtgccccaaccactgtgccagatgctttatatacattgccttccctcaatcctgagatcagatagatgaagaaactgaagcttatagaggtgaaataattttttccacattttcaataagagccaaagatgaaacccaatcagttgtcttccaaagcctatgacttagactgttgtagcaggaaggacagttggccagatgacctccaagtggccttgaagctcatagctagaaagtatgagctttatgggcaatggagaagcactgaaagcttttaagcagggggatggcatggtcaggttacatggagggagagtagtgtggctggattggcctgcattccccagaaagcagaagctggggcagaggtctatgagcttttcctttattagggagaaagatcccagggaacaagatgaagaatatggggaaggagacagggaaggagggagagtcaatctgaagatgcgctactgagctggcagctgattactcggtatctcttaaaaccatcttaggacagtttgtctggacgaaaaaagaggtaagaactcatccatcggtttccatattcccttggcaaaggttcgtacatggagcattacctccccacactctggggacacacaggaacactgaacatacctggacataaacagagcaggtcctgcagagatgagaaggatgtttggggtgtgaggtgaggcgccatcaggtcgcacctgtgtgaagccagtgagctctctcagagctggtgcctcagtgggtgctggaccaagaggccagtgaggacaagaggatcataagcagagcagaaacagcatccaattcagggtcagaggaggtggtgtgggctgaactgtgtccccccaaactcatatattgaattcctaaccaacggtacctcatcatgtggccttctttggaagcagtgtcattgcaggtataattagttaagatgaggtcatactggaatatagtgggtccctaatccaatcccttggcaaaggttcatacattgagcattgtccgtataagactggtgtccttataagaaggggaaatttggacacagaaacacacacagggaggatgtgttgtgaccatgaaggcagagttcagggtagtccttctacaagccaaggcatgctgaagatggaagtaatccactagaagctgagggacaggcacccaacaggctcctgcacagccttccgaaggaaccaaccctgctgacaccttgaccttgaacttgcagcctccagaactgtgagaccataagtttctgtcgttttagccgctctgcctgtaacgctttgttgtggcaaccccaggaaactaacagaggaggtgagattgggggcagggaggcccatctgtggggggcatcatgtcagtcaggcactcagtaactgggggaaaatcccaaactcaagtgggtgatggcaaaatggggaaattatcggctcatggaatggggctctccaaaggaagttctttgacttcaggcttgattcaagggtttgaacgaggatggtagggctctctagtccttgcccccttgtctccacatgttttgaactgcacgtttgtgtgcctccagaattcctatgttgaaaccctaacccacaatgggatggtatgtggagatggagcctttgagaagtgattagatttagttgaagttatggggattcttcatgacgggattaggcccttaccagaagagaccaaagagcatgctctctctctctctctctctctttctctgtctttctgtctctctctctctctctctctctgccatgtgaagatacatcagggagatgtccatctgcaacccaggaagagagccctcacgaggaaacaagcaggccagtaccccagtctgtaggacttcccagcctccagaacagtgagaaataaatttctgtggtttataagccacccagcttaaggcattttgtcacagcagccagaacagaccaagagaggtgcctgtgtcttgatctctagagagagcattggccaaggccaacccagccatgagagagagacagagagaggcagggctgggctgtggctggctggggtgtggactgatccagagctggcagtgggccagaggaagttcagctccccagggctggatctggtgagaggacatggaggtcagcaaacaagttagggtcctgaggcaccgggtgggggtggggttcagcaaggaggtcttggtggacaggatgtggcagtggcagaggagctagttctccagagctgagaccagagatgataccaggtaagtggcccttcacctgtgctctgtggcctcacttctgtagagaatcgaggccagcttcagggtcaagcttctcggctggaagctgggagttgttgctgtggttcactgagtggcagggatacagtgatgactgagaaaatgctgaagagacctggaagtcccccatagaagaaatctgattcttacagcgctgcggagaggcagtctgggaaggcctttcttcccagagtatctcttcaaggttctgatacacctcacaagccctgcaaatacagacagaccggaatggggctcccaggtccagaggagatattgggaaagggtccgaggagcagagcaagatgtctgcttagccggcagtagccagcactcccggcctgggcagccaaacaggcatctgcaaggggacttgacaatgatcggtggagcaggagggtgcttgagagtgtggctgcttaatcatggccttgaggtttgttgttgtttaaatgtcaccacttatttgaaactaattcctgtcagactgcgaaaagtttatcagtgtaattgggtgccggcaaaaagctctcttaaaatacacatcctttcattcataaagctatcaatggggcatttgattagcatctttttgactgccaaggaaaccatactgaaagcagggcatgcattcagaacaaagaactccagctcgtgggtgaaaactctgcgatagccatatctcccccaccagatagtgtgctttgtgatggctggcagcctgtgccccttggaaatgtcattttcagccccttctgggcttgtgactaaggtgtgggtggtggatctacaaaggatttcccaaaaagaaggcctcctttacataccttttgttctgtggactgacccacttgtcccacccacatacctgcagcaggcgggagagttgtgccttaactgggcagctgtgagcaccagtttttttccccaaattcctgggtgctatctgagcatgctgctatttggcagtggggcctcagtcacatcctgatggagaaaatgtgaaggtttgtcatcagcttatttaacaattcagaggctggagtctattccactttttgtccagtatgtagctttaaaacagttacatataacatggaacagtatgacatgaaaagagagaggtttatagagggagatgggaatcgtgacagcccctgcttacggagtttgcccctccagtcctgaattcttctgcatccccacatcctgcttgtctggaaaacggctgcagcttactacttcgattcttggccttccagaaactggactcctggcccatcttttcatctctttggagaaacaaacaacaaacaataatctcgtcataattaaaattcactgtgatataaagctactctaaaaatagtacaattaaaattaaaatttatttcatttcttgagctgacatttcagacagccaggggcctcccactaaacttgaaggtgatgagtctctgctcagtctcacctcccgggcttctgttccagcatgagtctgagctccattcaactcttcccgggccttttcagctctaggtgtaaaggttcagtgtgaactcgtagaaagaagacaggcttttcagtcaacagatctgaattcttacacgcactgtctcatagtccttggtctcagtttccatgtttgtacagtgaggatcatgggttccaaggatttgggttccaaggtggggttggacaatgaaaccatagctgtccagtgtggtggccatgggccacatgtgacttctgagcacgtgaaatagaactggcacaaattgagatgtgccaagtgtaaattacacattgaatttcaaagacagcccctacaaagaatgtgaagtgtctcattaataattttgtatattgattatatgttgaaatagcaatattttagatatattgggttaaagtatgaaaatcaacatcaatcttttcgttttactctcactattttttagagcagctttatagtcacagtgaaatggagtagaaagaacccaaatgaccactccatctgtcctaagccagtctgagggctttctgtccagccctaacgctgtaccatgatcctcactgtacaaatatggaaactgagaccaaggactatgagacagtccttataagaattcagatctgttgactgaaaagcctgtcttctttctacgagttcacactgaacctttacacctagagctgaaaaggcccaggaagagttgaatggagctcagactcacactggaacagaagtccaggaggtgagactgagcagagactcattaccttcgagtttagtgggaggccactgggctgtctgaaatgtcagctcaagaaatgaaataaattttaattttaattgtactatttttagagtagctttatatcacagtgaattttaattatgacgagattattgtttgttgtttgtttctccaaagagatgaaaagatgggccaggagtccagtttctggaaggccaagaaggacttcccgtatccttcctgggccccaaacatgcacagcctccccgttagctacactgtccactagagtggtgtgtttgttacagttgatgccagactccatggttcggggtttgctcttggtgttgtacattctatggatttggacaaatgcatcatgacacgtaaccaccattatagtatcacacagaatagtttcatggccctaaaaatcctccgtgtcttacctatttatcacctcctttcctgttaaaccctggcaaccaccgatctttttaccatccccgtagttttgccttttccggaaagccatgtagttggaataatactgtaagttgtctttcatattggcttttttcacttaataataagcatttaaagttcctccatttcttttcatggcttgacagctcatttctttttagagctgagtgatattccattgtctggatgtgccaaaatttatttatccactcacctactcgaggacatcttggttgcttccaagttttggcaatgatgaataaagctactgctgtaaacatccatgtgcaggtttttatgtgaacataagctttcaactcctttgggtaaatatcaaggagtacttttgctggattgtatggcaatggtgtgtttagttttgtaagccactgccaaacttcagccgattcctggtttccctattctcggcaggctggcctcacaaagttcgtctcctgcagagctccaaggaagctggttttggctgaatctgaagatgatcaacactggtaggatgctgctgtgtcatagactggaaccccagctcctgatcatgctggagtggggctgctgctccctgcaaccccacctgcctcccccttgagctggaagagaagggctgacggccagagttctgccataccccactacgatcagatcaagctctgatcccaccaggccaggggctgtgcttccttgatcatataagcccaaggtccggggtcgctctcctggagtctgacatcagcccggctaggtcccagtgcgctgctctggaagggtcagaacgcttgttcctgagcttatctctgtggattttccctgatgaactctgatctagcaggcagtgtatgggctgctaagtacttttcccttgtttgctcaaggagtttgcggccccaagatcatttccaaagccttttgcttcagcttgctaaagggaagctgctgtcactctcttcagcttgctaaagggaggcggagttctgaggaaggcaggcaccttaagggatgttgaaagttgcctctgtttgctgtgcctaccacctacttctagtcctcctctcgccgcccagatcatcccctacaatgcattacccatgcctgccccccaccacccagaagctatgggggctctggtccaagccccacacttgtccgaaagaggtgcctgggccccacagaagccttgtcagatgatggcagctctcttctgatagttcaatggatctgccacctacacagagaggtctggaagtcgctaactctctttgagtctcagattccatagtagtcaaatgaagggtttgaaccagaatattttcaagaatttgtgctcttctaagagtccatggtttttttaaaagttaatttaagttttaaaatttattttttattttatttaaacatttttatttattttttaaaatcttttattttaggtttcagggtacatgtgcaggtttgttacataggtaaacttgtgtcatggggatttgttgcacagattatttaatcactcaggtactgagcctagtacccaacagttatttttctgatcctctccctcatcctactctccatactcaagtaggccccagtgtctgtcattcccctctttctgcccatgggctctcatcatttagctcccacttataagtgagaacatgtggtattttgttttctgttcctgtgctaatttgctaaggataatggcctccagctctagcctacactatggaatactatgcagccataaaaaagaacgagatcatgttcctgtaaaggacatgatctcattcttttttatggctgcatagtattccatagtgtatatgtaccacatcttctttatccaatctaccattgatgggcatttaggttgattccatgtctttgctattgtgaatagtgatgcaatgaacatgtgcatgcatgtgtctttatggtagaacgatttatattcctttgcgtatatacccagtagtgggatttctgggttgaatggtagttccgtttttaggtctttgggggaattacctcactgttttccacaatgattgaattaatttacactcccatcaacagtgtataagcattcctttttctctacaaccttaccagcatctgttattttttgagtctatgatttatctttgtgggaaatagagtaattttaaggccctccaacctctccatggaatgaagtagagatctgccagcaaagccagcatcaggaccgagtagaatatccagtacatggcaggtgctgcgtgatttttgttaaaatcataatctcattttaagaggactgtcctacacaggccaagcttgattccatggctcttccagttaatttcctcatctaagttagtattagccatgtccacatctgagctgtgctattaaaagccagaccagcagcctcattgctcccatcgacaggcatatggtactagataaaaagccataaatgtccaaactgttgagaaaaaatgtgagatgagttgagggggacacaggttgccagcctgccactctgggccccgtgctggcctgggtgcagccctgtgtcctgtgttgctgacctgtctcccagtgtcaggcttgggcctccctaggaaaattttccatggggctctgggcctcctcctccctcctgccttgcctgaactggccccacactcaggactggggagtgtcaaagtgtctgagcctgggggaaggaacaaatgcaaagcacgtgaggattcctcctctggggagagtttatcccataagtaatgacatcacggttccccagccttccaggatggcatcctcaaggtcatcttcatcctctcttcctctacaggctctgccactgcagctacaaactgcagcgaaggcccccattaggaaaaatactccccacgactttgccagcccctgttctggaccttcttcccctcagagccaagccccacaagagtgttctacactcctggccaccacactctcactttctctttgcttctcagctgacaggcattttcacttctgtgactgctgaagctgctctgcataaaagcccatctctactaaagataaaaaattagctgaatgtgatggtggacaactgtaatcccagctacttgagaggctgaggcaggagaatcacttgaacccaggaggcggaggttgcagtgagccgagatcgcaccattgcactccagcctgggcactaagagcaaaactctgtctcaaaaaaaaaaaaaaaaaagcacaagtggcatggtcttgccatgcgatttgggtccttgcaatacttgatctttgcagcttcattcttgacatcacctccctgaaatctcctcttcccttagctcccatggcctgactccagctaggtcctctgtccctcatatgccaggctttcctggttctgctgtagcttttgtgtcctgcccccaacaccctccataagcaattgcaactgtgccccgttcccagactcacaccttctccagtctccgtctacctgcaggctggacgcctccacggcgtgttccacacatacctcaagtgcaagtccaaagcaaaatatggtccttctcagattccagctggattttccatcacagttattcctattgtgaaccactgaattgcctagttaggggcatctgattcagacttgttcctttagcttggactatgtcaagaacctccctcaatgacatctctgccaccaggccttttgtccagcgatcctttctctggacaacgtctcacatctgaccttgactctcccactcagcggttcctgccctctgcaggatggggtccccgtgctttcacatggcccctggccattcacagcttccccctggctggccttcctctcctgcttgttccagcaccccctcactcccaccccatgcttgaatccacagactccttatttttgggtcctcacatatgccacactgtgcccagctcaatgccttccgaatctcatgctttccaattccaagtttaccttctctgaaaacttttcctggctcccttgtttcgtgtctgcatccctggattttgcactttgccttgttcctgttgggcacttagggaatcttagagctggaaggatgcaatagagtctccatcttttcacctggctgtaaccccggcaaacaaagggtgtaggttgttatctcctgggcagctggcacagtgcctggcccagaataatgccccctgagagcacagtaaattggtttccaccgtgaagaacagatattggagcttgaaggtgagctagcctccaacaggggaccagggaggtgctaggccagcgagcccaccttccccacgatgcagccaatcaagactccagagggctccagcaacagcatgaaaaaaatagctctccatacaaagcatggaaactagactttagggcctaggggaatggggcttgtctgcctctatgtaagaaagcaggacaggccgggcatggtggctcacacctgtaatcccagcactttgggaggccgaggagggtggatcatgaggtcaggagttcaagacctgcctggccaacatggtgaaacaccgtctctactacaaatacaaaaaattagccaggcgtggtggtgggcgtctgtaatcccagctactcgggaagctgaggcagagaaatgcttgaatttggagggaggaggttgcagtgagccgagatcatgccactgcactccagcttaggcgacagagcgagattccatctcaaaaaaaaaaaaaaagaaaagaaagcaggacagtatattgcaaattaagctcaataaaaagagagaaagagagggagagagagagaaagagggagggaggaagggagggatagtgagaaggaaaggggcagtcaggcagaccatggtcccctgccaattctctgggcaccggtggaagcaagttctgcgtcttgggcacagtactttatcacctgattgtacttcctccacctctccccaggcagaactattgacccagggatctataacatttgtatatatcaacacagaaaccaattaacaaatgcttatattcctgtgcaaatatgcaaacttccttctgcagacaggggtaagcagacacctggcagtatttttagaaatatttaagaaacacagttcaggtaagaagcaggctgctgtaccctcctccgggaggaccagtacctagaaccatctgtttttctttgtcttccctgctctgctctgagcgtggggatggtccttatccttagcttcatctttattaaagctggcattttcggctgggcatggtggctcacgtctgtaatcccagcactttgggaggccaaggtagatggatcacttgaggtcaggagtttgagatcagcctggccaacatggtgaaaccccgtctctgctaaaaatacaaaaattagccaggcgtggtggcatgtgcctcgagtcccagcactcgggaggctgaggcaccaggattgcttgaaccctctgcagtcagccaagattgcgtcacggcactccagcctgggggacagagactctgtctcaaaaaaaggaaaaaaaaacagctggaattttcttcagtgcttacgctgtgccagatacatgcatttactcacttcacaatgagagggaagccactatgtttatcagtgaagcagggtcatttgggaagcattatccaacaccacctactatgggcccagcccatggcaactggaagcagcactactcagaaggaaaggcatgtggagaagctcagagctgacaggggagtctatacttgattgtaagatttctgtacaaaatgcctttctgtgtgctgtatcatgtagtgaaagataagaaacaatagaatgtccagcaatcagagaaggcttgacatgacaggctactttttaacagcactgagaaaagcttgctatctattaaatattttaaaatcaggtgctaagccgcagagtaagcacctcattatttggaaatgcacttatacattcacagaagcaacacccctggaaggaaataccccagtgatcatgggattgtagtaacatttttgtttgtactttttatataccttaaatttaaaattccttatgaataggtgaaaagcctgtccaggaagctttgtagggtcccctgagttcttggtgttctgtcagtggaggctggtttgagtcattcctgtaggagagctacccaaaacaaaacgaaggggaagcaagagatgcaagcttctaagcctctgacaccttttgcaaaattgctttcctgcaaggctgtgctgcttcacctgctcccccaccagctggtgtgagaggcacagggtttggagcagacagctgtgttctgaagggatggcattctgtctggtgacacttagtggcagtccacttttctcccacaggttgctggctgatctagttgccaaggctcctgcgtaggtgttatctccaaacatgcaggcatagttaagagatgagaaatacacgtgtttggacaaaagactggagcacagttcaatcagcctcagcaacattatctctaaaagcaaatgagtcctgctgttgctggggacctacccctctgccttggctggaagtgtttgagtctgtctgaacggtctgttatctccagggcaacataaagtttgcaggaggcctgttcactccaggtgttatcgctgtcgctgagatggtgctaagcctacaggcggcagaaggccaattgctaaggcagagggagcctttagtggggagccaggcagcctggggaccctgggccacagcttccttccctatgacatgcactctcatgcccttcccactcaaacatccagtcattctgcacgtcctggtagagggagatgccaggcgaaccctcggggtaaccccagcacctggaaaaactcctcagtgggtttgctcagtgtcatttaaggatcccaaccttgaaggttttggacttgggatcacacattgtttcattcagagtgttaggataggggtctgtctagttcaggcatctcaagttagagatgagaaaccagactcagaagtctgacggtccttggaggctggccgagagaaagacctgaggctccccgtctccctgcctgggcacctcataccaccttgcttttccctgccccatgtcaagagcaagctggagccgaatttggggctcccagttgggctccaagtgtgatttcctccacacttgatgaccaggaggccatttgtaggaggctgggatgagcaaagtgggtcaaagtgccccctgcctccaaatgctcgcgtggaggttgggcagtcagacaccatgggggagaaaccccaggactttagcagaacaaaagaagggcaccctcccttcctgggccctgccagactcttggcagaaggccagggctactcatggggcggggagtgggggaaggagggaggagcagggatggtctgttccagccctcctgtgttcatcctgagccgagtcactgaggcctgcagcacagctatgacacaacttttggggtgtcctggtaggagggctttgggctgcaggtggggcattggaagcagatttctctctatagtaaggcagtagatccccaggccttgccctctgttcctgaaaatgtgagttgtaccttgaaccacaaaatggctgtggggtgcagcttggtgtgttggaaggagggctttggatgtgggctgcaactgcatcatccttgctcagttctcatgtggcaggtgtgctcctgcctggtctggggcagtctggcaggctgctctgtagccccaagcctggatctgccaaaactggcaaggagtggaggcctccccgtggagcagtgcctgaacctgcagcccctggggcagacactcctggctcctgggcacctcactcaccatggctccccactttcttagttggctcgggccgctattgcagaatgccatacaccacgtggcacgtggacaacataagtttatttcttacagttctggaggctgggaagtccaggatcaagtagctgaaacagatttggtttctggtgagggcctcttactctttcatagatggcgccttcttgctgtgtcctcctatggcagaaggggtgagggatctctccagggtcttttataagggacctaatcacccctgcacaacccagcctcctaatagcatcaccttgaggtttaggatttcagcacatgcactttgggtaaacaccgtcaatctagagcatcctccccccccatcatgctggcttccagactctgctcccaagtgaatgtccacacccaaggggggccctgagtcttccttaagtctctttgtctaggacagactgtgctgaaagggcccatctaatctcctgatatggtttggctgtgtctccatccaaatgtcatcttgaatgatagctcccataattcccacgtgtcgtgggaggggcctggtgggaagtaattgtatcatgggggcaggtctttcccatactgttctcgtgatgctgaataagtctcatgagatctgatgattttataaagagaagttcccctgcacatgctctcttttgcctgccaccatgtaggatgtgactttgctcctcattcaccttccaccatgattgagaggcctctccagccatgtggaactgtgagacgattaaacctttttcttttacccagtcttggatatgtctttattagcagtgtgagaatgagctaatacatctcccaacagcctgggccccacccacccccactcctcaaacctcctcagtctgtccttgtacaggttccttctcctccagccccatctcgcttcatgtgacttctttcttccttaaactctctgcactctctcctgctcccaggattttgtatctgcagtttcctctgcctggaatgtactccacctggtctacaactcccagctagcctggagtggagagcttctatgtcactccctctgggatgctcctgctgacccccaagactggctcaggccctgagttcgaccctcttgtggttcagagaattcctgggcatagccatgccctcacttgtgcttccactgccacatggggttgctggactgttgtccacttcctcaggggcatctgcttcctcagaacagggcctgggcattttgtcacctaggattccagtgccagcacagagagtgggctcagctgcagacactcagcaatgttgactgaatcaggaggcagcaggtgactcgatgttatgggctcacgggaaaacccctctcctcttcagagggccttaccctgaggtggcctcaccccagttgtcttcactgggtatgggtctctttgcccacccgctgctgcctcactaaccttcctggcctcagacaaatctaaactcaagtcaaaaccagggtgaagatgggcctacgtcagctccagagagggacagcctgaattcccctccctctggtcccatttccttgggaggatcagcctcttcctggatgatgacaccagggctcttcaccccctagggaggggtccagcccatgtctgtggctctggtctgggccctgaggggacacacagtaagtggcaaacacagacggaccaggccgagagcaagacaacatcctcaatggttaagatgtataggccagagggaaattgatcaggaaatgaacttagaagtatccagggactgatggggaaggagctgtatttggaggacctgtgatgcaagttacagaatcaaagatgtggcccctggttttgctgtgtcctcctggaatgggtagcaggacaggagccaccatgcagagggtggtcacacactcgggcttgctttaacctgggtctttccttaccaatgcatttctggctacactggggaaaacgaggtggctaacacattttttttaggtgttagaagacctgtgtgcactttctctctttctccctgcactccagccacactggcctttgagtttgtagaatgcctacactctgctctgcctcagggcctttgcatgtactgtgctcactttatggaaagctttgttctcaatctcatccaatctctttaattatttgaatgctatccatccttcaacattcagttcaaatatcatagccagtaaaatctgctgtaataaactctcttagtttcctccaatttttcttcctaatatttatctcagtttgtagtcatgtattcttgcgatggttgggctaatatctgcctcctcactggtgtttaacctctagtaaacactagaggtttaatctctgaggtcacatctctgagggcagagatatgagtgacaggtccagtcttattcccaacatcaaggccagagcctgtcaggcagcaaatgcttagtaagcatttgttgagttgactttgaattgtcagagctagagggtcggtttagcattgacacatgggggacatcatgggagaagccacgttttgttaggacctggccctggggagatttcttaagccaaaggctttgggtctgccacccttccatccaaggagaagtctgaagacagggtcagcattttgtttgtcctccacagttgctaactttttttttattttttgagacagagtctccctttttcacctaggctggagtgcagtggcatgacttcagctcactgcaacctccgcctcccgggttcaggcaattctcctgcctcagccttccgagtagctgagattacaggcatgtgccaccaagcccagctaatttttgtatttttagtagagacagggtttcaccatattggccaggttggtcttgaactcctgaccttgtgatccaccctcctcggcttcccaaagtgctgggataacgggcgtgagccaccgagcctggcccacagttgctaacttttaacacacaggacatttcatgtaaaaattgtgacttgcagcttcttttgaagaatctgaagtcaagcagccctggcctgcatttgtgcatggctacctttgtgggatcttggtcacagctgaccctttgggtgggcatgctactcttcagttagttgggccctcttcactagttttttcactagtttttagcacctgcttgcccctgttagcaggtatggacttttacctgaacactcagattagaaagagatggaaaaaccacatggccttgcagaataagggagatctcatctccatgcaatgaggaatcagtggcaggcctctttgcagaacctccctggaagggaattgctatggttgcatgtgtcccacaaagtttatgtgttggaaacttaatccccaatgcagcagttttgagaggagggagtaatgtacagaaaaatatccagaaatctgtacagttgatatggcttggctctatgtccctacccaaatctcctgttgaattgtggtctttagtgttggaggagaggcctggggggagatgattggatcataggggcagatttcccccttgctgttcttgtgatagtgagtgagttctcatgagattatcactccccctcctgctccaccatgtgaaggatgtgtttgctttctcttccccttcttccatgattttaagttttctgaggcttccccaaccatgcttcctgtacagcctgtggaactgtgagtcaactaaacctctttaactcataaattacccagtctcaggtcattctttatagcagtgtgagaacagattaatacaacagggttccccatggatctgttataaaaattaggttgtggatgtctatcataaaactccaggaggctgggcaaagggtgattggaaagcagtgagcaggcactttcagagctcatgtgggacatggggggactcctgcattcctaccagccagagtggagcgtccttgtagaaaatctggtgcgttcagttgacatcccagaaaagtcatgtcttggcaggaggagtaaagaagccctaaataaagtctaatctaacccctttccttcagtcaaagcttcaaaacaaacctcaaaagggtcagggtaatttctaagtaactcagctggctgccagaaaaatatctaccaatctttagaggaggacaacaaaatctagcattaagtaaggtataattaacaatgttcggtgtcatataagaaatacagacatgtaaaaatgcacagaagtgcaactcctaccaagagaaaaaccagtcaatagaaacacactcaggaatgatggatgttggaaatagcacacaaaggattgaaaacaccaattacagatatacacacgaatttaaaggaaacatgaaagtaatcatcaaagaaggagaaaaattaaaaaggaaatacaagggccaaaaataaaaatcttaaataaaaaaatttctttatgaaatgaacagattagacgtgaagaagaaaagatcagtgaacttgaaagttgcaatagaaactttcaaaactaaaattcagtcaaaagagactaaaaagaaaatttaaatgaatctttagtaacctgtgggaaaatattcatgcaagtatatggatcacatacttgtaattggaagctgagaaggaaaggaaagagggaagagaaaaaatatttgaataatggtaaaaaatgctccaaatttgatgaaacatacaaaaccacccatccatgatgctcaatagatcaaaagcaagataagcacaaagaaaactatgcaaggtaaaacataatccaattgctaaatgccagtggctaagaaatgtgggtgggcttcatcaaatctattgaagatctgaatagaacagacagactgactctcctgcaagtaagagagaatttcatcctgcctgactgctttgagctgggaggtggttttttttttttcctgccatttttgaactgaagtatcagctttttatgagtcttgagcctgccagcctttgaactggaagtacaccattggctctgctgtttccagcttactaactgcagattttgggacttgtcagcctcaataatcataggagccaattccttacacacacacacacacacacacacacacgttatgcatatgtacaaaattatatatagttatatattatatttaagtataatcatatctatctattccaaaattgggtctctaatctgattacattttaagttgctaataactttatttccaactgtaaagagagcactaatagtccatggcatgatctaacaataaagatatcaccactggatactcctaatcaaccccttataagagacaaggagctgggtaactgtgtatactttcaattattttcctcacactaacaaatataataagactcaccaggtgtttctaatgtgaagtgatactaagtggacaaaggatgaaaaacacttaatggtaagtatgtgggtaaatacaaaggcttttctcatttttaaatttccttaaaagataattgattgtttaaacaaaaataataacaacgtactgtgtggcttataacctattaaagcaaaatatgtaatgatagcatgatggacagaatggaggaaatggaagtatatggttgtaaggtcttacattgtacataaagtgttataatagtatatttgtaatgagctaatgatacatattgtataccctcatgcaaccactaaacatgaagccagagttatagctaatgaactcacagtggagataaaatagaaccataaacatttttaattcctctaaaagaaatcaagaaaagagaaataaaggatgaagaacagatgaaataaacagagaacaaatgacaaatggtagatttatacccaactatactgataattatataaaatgaaactggtctaaaaattccaataaaaagacaaatatttttagactgtataataaggcaagactcaactctatgttgtctgaagacctcaataatttaaaggcacaggtaggtcaaaagtaagaggatggaaaaaaatatactatgtagcaccaattataacaaagttggaggggctagttaaatatcagaaaaagtaaacttcagaacaagaaatatgcagaacaagaaataaacgagaacatttcataatgataaatttatcagaaagagaaaaattgtaaacatatattcacctaataatagaacttcaaaatatgacaaagaaatggacagaaatgaagggggaagtagagaaatctacacttatatttacaaattgtcatacttgtttctcagtaacttatagaacaagtagaaaaaatgaataaaggggaaggacacttgaacaatactactaaccaacttgatttaattgatgcctatagaaccttctacctaaatacagatttttaggtgtagtgttttatatcctaggaatgcaaagtcagtttaatcaacagcgcaataaatcaatcaatgcaattcagcatattcgtagaatccacattgtttccaactgaacacaaaactttcattataatggaccatatctggggcagaaaacaagtttatacatttaagaggaccaaaataatatagaacatgttatctaaattcagtggaactaaaatagaagttaatagcagaaggatatctagaaaatccccaagtatttggaaactgagcaacatacttttaaataatacatggatcaaagagaaaatcacaaaagatattttaaaataatttttcctaaataagaattagaacacagactatcaaaatttttgtaatgattagagacaaatttataactttaaatgatttttattagaaaatataaaaagtccaaggtcaatgatttaagctttacttttagaagttggaaaaagaggagccaattaaacctaatgtaagtagaagaaaggaaatcaagttaatagcagaaaacaatgtaatagaaaacggaataataaagaaagtcaataagataaaaagttctttgaaaagatcaataaaattgataaactcctaataaaaagtcataaaacaaactaccaacatcactaataaaagagggaataaaaattacagactatgtagagattaaagaaataatatggggatattatagaagctttacggcaacaaatttgacaacccagaggaaatgggaaaatttttcaaaagaaaaattactaaagcccagtgaagaaaaaatagataacctgaatagctttataaccattaaagaaattaactttgtaattaaaaactttcacacaaggaaaattccaggctccagtgacttctctagtgaattcaatcaaatatttaaggaagtagtagtatcacttttatacaaacttgcagaaagtaaaggaggaggaaagactttctaacttaatttatgggatcagcataatcctgatatcaaactcagagaaaagatactacaagaaaaaaatcttataggccaatgtccacaaggaatatacatgcagctgggcaccatgctcacgcctgtaatcccagcactttgagaggctgaggtgggtggatcacttgaggccaggagttcaagaccagcctgggcaacatggtgaaaccccatctctactaaaaatacaaaaaattagctgggtgtggtggtgtacgcatgtaatccccgctattcaggaagctgaggcaggagaatcacttgaacctgggaagtggaggttgcagtgagctgagatcgtaccactgtactccaggctgggagacagagcaagactctgtctccaaaaaaaaaaaaaaaaaaggaatatacatgcaaacatccttaaaatatttcagtatgttgaatctaggaatatatgtagagggtaatacactatgaccaagagtgcttatcctagaaatgcaaagttaatcagtgcaattgaccaatcaatgaatgcaattctagcagtttaaagcagaaaacccaggtgatgatctagatagatgttataaaagcatttgacaatatgcaatactcattcacgatgtactttttttaaaaaaaataaaatcctcttaaaacactggagtagaagggaaactcatcaacctgaaaaaatgctgtcatgaaaaacctacaggtattatcaaatttgatagtgaaagtcataacgttttcctcctcaggttgggagtgaggcaggaatgtccacttttgccatgatcattcaacactgtaccaaaagtcctaggtggtgcaataatgtaagaggaaataccgacataagattcgaaaggaggaggtaaaactgaatccattcatagaagaaataataatgtacttgaaaatcctaaggaatttacaaaaagttactaaaataagcgaatttagcaaggtcataagatacaatggtcaataaacaaaagatcagttgttttcctaaattgtggcaatttggaagattaaattatataaataatactgtctatagtaccatttgaaaatacttacaagatgagcaaaatctctatgtaaaaaactatgaaacattgtggagacaaagtgaattgccaatattgttaagaagtcagctctcctgatttttggttgaaattgacaaagcgattccaaaatctacatggaagtacaaataatctagaataatcaaagcaatttttacaaagaatgaatgttgaggacttatctactttatttcaacattacaggaaagccagtaatgaagacatgtggtataggtttcagtttagacaattcatcagtggaacagaatcagatgtcctgtttctggacatacataatatgttgattcctaacaaagttaccaaagtaatttgatggggaaaaagatagtctttgaataaatggtgctaaaacaagtgaagatctatacatgaaaaaagtgaacttcaacccttacctataccataacttgaaatgtatcacagacaaaaataaaagctaaatttgtaaagcttctagagaaaaacataagagaaaatcttcacaacttgggcaggcaaagatttctcagggcacataaaatttttgaggaaaaaaattgataaatgggccttattgaaattaaaagtttttggtctacaaaagacaccatgaagaaaatgaaagggcaagttgcagaccaggagaaaatatacacaggtatttggcaaagtaatggtatgcaaaaattaaaaagaaccctggaagattagtaagaagaagacaaaacaactttatcaaaatgggcagaaaattttgagcaaacacttcccgaaacaaccaataaacacataaaaagatgcactgcagcattacacatcagggaaatgtgacgacccctcacaccatgaggatgcctgaacttaaagatcgacaattctgaatttttgtaagaatcaggagcaactggaactcttgtacaatgttagtggaaattcaggattaatgctgtcacttcgaaaaacagtttggaagtttcttatgaatttaaatatatacttaccatacaaaccagaaatttccacatcaagttaaaaagctgcacagcaaaggaaatgacaaagtgaagagacagcctacagaatgggagaaaatatttgcaaactacccatctgatcaataaccagaatctatgcaaagctcaaacaactaaataggaagaaatctaataatataattaaaaatgggtaaaatatctgaatagacgcttctcaaaagaggtcatacaaatgaaacataggcatatgaaaaggtgctcaacatcattgactgtcagagatatgcaaatcaaaactacaatgggatctcatgtcaacccggttaaagtggcttttatccaagaaaggcaataacaaatgttggtgaggatgtggagaaaagtgaacccttatacactgttggtgggaatgtaaattaatacagccactaggatgaacaatatggaggttccccaaacaactgaaaatagaactaccctatgatccagcaatcctactggtaggtaaatacccaaaagaaaggaaattagtatatcaaagagatagctgcacttccatgtttattgcaacactattcacaatagccaagatttgaaatcactctaattgttcaccaatagacaaatggataaagaaactgtggtacatatatacgatggagtacgattcagccataaaaaagaataagatcctgtcatttacaacaacatggatggaattagaggacataatgttaaatgaaataaaaaaggcacagaaacacaaattttgcatgttcttactcatttgtgggagctaaaaattaaaaatattgaactcatggagatagagagtggaatgatggtcaccagagctgggaaaaggttgtgggtgtggggggtgggaaatggagatggttaatgggtacaaaagtagagttaaatacaatgaataagatgcagtatttgatagcacaacaggttggccagtcaacgataatttttagtatatttaaaaataagtaaacgtgtataattggaatttttgtatcacaaagaaatgataaatgcttgaggtgatggataccttgtttaccctgatgtgattattacgcattgcatgcctgtatcaaaacacctcatgtactccataaatatatacacctactatgtgcccataaaaataaaaaaaaaaacagaaattcctctcctaggtatttatttattcaagaggaataaaaacacctgtgttcacaaggacttataaacaaatatttataacaattttagtagcctcaaactggggaaaaaccccagacagtagaatggataagcaaattgtgatattgctgcagaatggaacactacccaacattaaagcaggagagattacagatacacatgacaaggagaatggagctcagaaacattatgatgagtgaaaggagcccacacaagagactacagtcatggtggtatagtttggctgtgtccccacccaaatctcatcttgaattcccgtgtgttgtgggagggacccagtggagggtaatggaatcatgggggcagatctttactgtgctgttctcatgatagtgaataaacctcatgagatgtgatggtattataagggggagttcccttgcacaagctctctctttgcctgctgctaaccatgtaagacgcgacttgctcctccttgcctcccgccgtgattgtgaggcctccccagccacctggaactgtaagtccattaaatctttttttttttttgtaaattgcccagtcttgggtatgtctctatcagcagcttgaaaatggattaatacacaacgatgctcaatgacagtgatgcgttctcagaaacacatcattaggggattttgtcattgtgtgaacatcatagagtgtacttacacaaacctaaatggtacagcccattacatacctgggctctatggcatagcctgttgctcctaggctaccaatctgtgcagcatgtgactgtactgaatactgcaggcaactgtaacacggtaatatttgtatatccaaacatagctaaacataggaagggtagagtgaaaatacagcatagaagacaaaaagtagtgcacctctgtggggcatctaccatgaatgaagcttgcaggtctggaaattgctctggatgagctagtgagtgagtggtgagtgaatgtgaagtcccaggacatcattgtacactattacagattttataaacactataaacttaggctacactaaatgtattttaaatttttttcttccttcaataataaatgaaccttagcttctttatgttatcaactttatttttttaactttttgacttttttatattaatacttagcttaagacacatgttgtataactgtacaaaaatattttctttctttatatccttatcctataagcttttttctttttttacattttaaattagaaaaaaattaaaatgaagacacacacattagcccacacctacccagggtcaggattatcaatatcactgcgttccacccccacatcttgtcctaccagatggtcttctggggccgtcatgcacatggagctgtcatctcctgtgatgagagtgccttgttctggaatccctcctgaagaacctgcctgaggatgtgttacattaactttttctttttaataagtagaaggagtgcattgtaaaataatcatgaaagtatagtatagtaaatacataaactgctaacagtcgtttgttatcattgtcaagtactatgcactgtacataattctatgtgctagattttatacaactggcagtgcaggtttgtttacaccagcatcaccacaaacacctaaataatacattgcactaggttgttgccaggcgataagattctttcagctccattataatttaatgggatcaccgtctgtagttgactgaagtgtcacacagcatgtgactgtatgcatattcacctcctagaacccagactcatacgaagaagtagggaataccctactcgcaaccatgttttatttcctagtttcttccattggccattttctttttcaggctggagacttccctcccatccccactggcgttcccagtctctctgcctcctaagtcttcctctgttgctctctggggaccagcttgtgcagcagttttgtatcactgtagggtagggcttcaatgagccctgtcctgtgtccttccctggctcactgcgtcttgccttcccttcctcgcacagcccagggcctgacaccacctcctgcagttggtcattcaggagcagggcactcagggaaggagacggctctgcttcgagtatagcctgggcaccatccacaaacgccttggtgtttgaactcacctgtgcatcccagatacaggtatagtctctccaaaacaaagggtgtaggaaatatttttacttctccatctttccaaagtatccttcccttagtatctcagcaaccttccccggagaggctctttgggctgtggatgtagtacccagtatcctgggctgcagattcattgattttccatgctttgattgggtataatcatgctcagagctgagcaaggttggcagtgagtgggtcactgacatcagcttattcatgatctctctgtgctccgattctgacatgaacttccttttctgtctcagaggagagagatttcagggctgtgagcctgaggatggaccaacacgcacgtcagttgtgtctctgaggactaaagatggccaggacccaggaccccagctagcctccagatgctgctggctgctggggacccgtgacctaaggcacacccctcaacacattttctttcattcctgtcaatctcctgtactggtgactgggctgggacctcctgctggcctccagggccccacctgagcctctggtcccggcctcagtcaggcccaggcctaggggaccggcttcttgtttcctttcccgagagctctctgggagtccttacaatagattccaacccaggcacttttgacagtgaaagaagatttgtattattttcttagggctgccgtaacaaattgccacaaacttcacggtttaaaagaacagaaatttattatctcacggttctggaagtcagaagtccgaaatcacagtgtcacagggctgtgctccctacttaggctccaggcaaggttcttctttgctttcctgcttccagtagctccaagcttggctcgtggctctgatctctgcctccagcctcccatagccttctcctctgtgtgtgtctctccttttctgtctcttacaaggactgagtactcaaacttatatctaacaaagtactggtatcaaaaatataaaaattactcctgcaattcaataataagaagacaaacaacttaattaaaaatggcaaagtcaggatgaacttacctgaagatccttaatttaattacatctacaaagctgttttatccaaataaggttatagtcacaggatccaggagtttggacccagaccaaccttttgtgggggccacaattcaacccactccaggattttaataataactattccataacaaaagacagaacaccatgactgtccctccattcacctgcatggcctctgaaacctaaggacaccttagaagtggcatctctagctcggcgtggtggttcatgcctgtaatcccaacactttgggaagccgaggccggcagagcacttgaaatcaggagtttgagacaagcctgggcaacatggcaaaaccccgtctccactaaaaatacaaaaattagccagatgaggtggtgcacgcctgtaatcccagctatgtgggaggctgaggcaggaaaatcatttaaacctgggaggtggaggttgcagtcagccgagatcgagccactgcactccagcctggaagatacagtgaggttctgtctcaaaaaaaaaaagtgtcatctccaccactggctccctgggccacagacaggcagggaggaaaaggactcagatccctcgtgtgccttccaccgacggcttcgcctcctcctctaacaggtctgtggtctgatgttgagtccatgtggcccccagtctatgccggaggtactccccggctaaccctagaagccagttgtattagtcctttttcatgctgctatgaagaaacacccaagactgggtaatttctaaagaaaagaggtttaatagactcacagttcttcacagggcagcaggagagagaatgagtgttagcaggagaaatgctgggcacttataaagccatcagatctcacgagactcactcactatcatgagaacagcatgggggaaaccgcccccattatccaattaccttcatctatctagtcctaactttaacacgtaaggattatggggatcgtaattcaagatgaggttttgggtggggacacagccaaatcatatcaacgatgttatcctgtcagaactcaagagaagggtgagggctgggggagggccgggggatgatcccatctgaagtggccagtggaagcagttggccttctggagagggaggcaggaaaggctaggaggtaggtggccttggaggcccagagggtagggggagaacgtgggggtggagtgacagctggacatcccgaggtagggactggaaaaggaggcctagggagttccagatgtacccacctttctctttgtaacttaatgctggttgcatgacctgtaggtaacgttgcaggggacttggggtacagtatgagctctgtggttccctgctttgagaaaaggaatcctctttacaaactttctatgtgattgtggtgggggtaataataaagagagccccccactgcccaccacaagggcagtcagaggacccacattggccagagtgtgtcacacattggacgtgcttattaggttgggatcagcacgtggacagcagggccaactagggtccattgttaggaaactgagtgctgggagagcagttgtctctccttcggcatgtgctctaaggagtctgagcttggacctgctgagcaccatagctgtctcctggggagactgtgtctgaagctggagcccaacagagccctgcagaggccagagacggggagggaaagttcaggaccttgcttggactcctggatccaacctcacttcaaagtcatggtcacggatttcccagttagagagctcaccttgagaggtggggtctctgtcccatcccctggaatctaggtgagctctatgacttctctgacccatagagtgaggcacatggtgctgtgcccgcttctaagctcagggctaagaggctgtcagcttccacttcctgcctttctgatccagatgccatgctgtgagaaggcccaagccacatggaggagctgtgcctaggcctgcagaccacagccctcactcggttcccagctgccagctatgtgaggaagccacttgggatgtccagccctgtcgggcctttggatgactcagacgccatctgactaacccagggagagaccccacacaacacctgcctggcttagccaagccaactccttcaactgtgaaagatggtgacaaattattgttttaagccactaggttttgaggttattatgcattatttgaaaataattaaaattatttcaaaaactgtttattgtgactgatatggatgcctaaggtccttgcataaatgtgtcctcacttgatttagatgccaaaataggaatctgcaccttgaatctcatcatgagctccatgaagctttgggtagcctcaagaattctagagtgcaggggcttaaattcaaataactctggcagaacactgatggcctccctcctctggctgtatcatgcacagcctgcttcagctaaggggacagaaggagggagccagcatttctctgagaaccaattataaacaccttgggggaactctcatgatcagtaagatgctttctgagcatcgctttatgcatatgctaagaagctggggcaagagtagctttttttttaatagtacattttatgtaaatttttactgaagtgaacagacatatacaaaaatacacaaattataattatatggttcgattaatctttgccaagggaaccatgtcaccagcactcagattcaataattgaacattgtaagcacccaagaaactgacttgcaccctgtgttgatcatgcccccccaacagtgatagtcacctcattctccagaggccttaggcattgcctcaggatcatggtggaagcttctctgggtggggctgcttggggaccagccatcctgcagtgggcccatgataagcacctgtggcgccacacccctggctagcaggcctgctgggaacacctgtaggaagaccttggcaggatcattggcccttgagtcagctgcttgctcaacttcatgatcagagataaaggtgaatgcaagtactgtggccatgccatgcttaggactcgagaatggtgcagcctctctgtaggccagggaaggaccactaatatggctcccagccaagggcctcagggattctgaatggcacagtctctgcagaacttgcactgtgtggcttcaggtcttccaggacagctaaaatgtgtgggccttgagggtgcctttgggtgctcatagcctcattagggagatgaagaggtgagcagatgtcacatatgccaagacagtggaagcattaagaaaggggaaaggatggggaggatatcaccccaaaggtatgggaaaggacctggtatgtctggaaagtgaagaaggccagtgtggctggaacaaaaggcacctggccagagagctgggagatgagggcagacaaggaggaaggggctttccaggcaaggctgaagcctggatttacccagaaggcaatgaagagccaccagacactttaggggggccatggtgttgtaaaatgaagcatttgggctttgtcccaggttcctggaagggagcttggcattttcagggtggcaggagtgtctttgctattcatcgtgggtccctggggccacaccggagtttatgctgaccaggtgcttcaaggtgggactccatagcttcaggatgcaggctggccaaccatggcaagaccagccatgtgaataaagggtcaggactttgagccacatgatatcagcctgacctctggggagagagtgggtattggaattgagtacaaaggtgtaagcaatgatttcatcaatcatgcctaggtaacaaaccccaataaaaactctggacattgtagctcagtgcagccaccctggttggtaatcgtataaccatgttctgggaggcttcacatttgggaatctccccaaacctctccctgtgcatcttttcatttagcttgtcctgatttgtaccaatcaataaaactggaattgtaagtgcagaggttggtgagtcattctaatgaattatttattcaacttgaagccctgagtgggagcctctatcttggtagccagtgattggaagtgtgggtgcactgggaatgcagctggcatcctgcagggccctaagtctgtggcatctgtgctaacatcaggtggttactgtcaagactttcttcactcagtcaggtctgtgcttcaggtgcactgctctgtggagtggggagggggcctggagtgcatttctgctcatggggctcatgatttgaactcaggcctaatatgttaatgagcagacacctggccaagccctgggggcctcaaaaaaccaagacaggggaagcatcaagaatgtgatgagagagtacgcggccatgggagtgtcacctttgccttctcttctccctgtggctggaaaggctggcctgtctggctgcccaaggatagacggggagaggtttaattgaatcacctactgtgttgggtaaagtaaactgtcgtcattgcaaatataatcaggactgtattttaacagtagaaaatgtgattataatgacatatttatcagctcctttcacctgggtggatctgaggacatttcagaaaacaagtgattggaattgcttggcctacctcacacacttacacacacacactctcacacactcacagagacacacacttataagcacacacagtcctgtgcatgcacacaagtgtatacacacccacgcacatttccacatgcatgtgtgtgcacactcacatacacaaacacacagagacacacccttacagggcatctggtgctctggcctgctctgacacgcagcccctcctgggagtgggcagtaagcattggggggacatgtaggtagtccctggggaagctggaaggctgaccacctggcgagcagcagggcacactcactggagcccctgcctggatgagctggctttgctcagctccagctgtggttccctctgtagactgtgggatcagaaagccctcatcacatgatgtaactctcacaaggctgcaatctacttccctgtccaggtcccagaggctccaggctctttgtggagtcacctgcttgggcagccacggttctgtggagctgcttgtcagagagtgcgcaggctctggagtcagtcagacctgggtttgactgctgactccatctcttacctgctgtgtggccatgagcaaatgcctgttctcactgggactcagtttcctcatctacaaagtgaaacgtgttcatacttcccttatggtcagtgaggatggaatgggataacattctgcaccccgcctggccccacaggcatatgaggtattcgataagtgaatgattgtgccagacaagaaagctgcctgccctcctcctcctcggccctgtgcagggactggggtggatgagaaagcccgtgtttcctgaacacctgtttgcaccaggcacctatttggctgctgcctggatgtccttctcaggttccagctcaggtctcttggaccagtcccctggtctggggtagggatgcctggaacggctctagcggcaaggtcatatctcgccaggctgccaggatgagctgagcattgtgtccacggtgggtgtctgaaggaaataatgtatacagtggtccatttccaagaccaagtgccttgaatcggcttaggtcagcaaactatagaagcaacaggacatactaggcccctgcttggatagctgctgcctgcttgtcggcctcccccttcttccctcttccccacccccttagttgccctcacccgaaccaaagaagtttagataaaagtttattagtctgcaagatagcttgatttgtctcttcttgtcagcctgcctagctacttaggtcataagtcaaacacttgaagagcccctgagctgactaggattgcaatgcattgtgagctgcaacaaaatgcagcaagacaaccctaaaaaaaaacacctaaagcccctacctaacaatcaataggcaacatccgggaaaattgtgaccccatagtactcagtctatgagcaactgggggagggacccgtactctagggataaactgcttgtcgaaactgctgggtgtgcttgtccatcagacacctgatcttgcaagttcatcattaaaagtttcactttcgctgttctctgggtatctgagtccattctttgggtttggacgggtaagtttgtttctcacatgtacaagccagaggtccatgagtgagaatcgggggccaaggagctttgtccatggggccgtaatgggatgagagggcagaggttatcaaactctgagggctggaggaagacatggtttctacctcttatctcatttcctactcatttagccttcggaggcaggcactgccgctatcccaccgaggaggagtctgacactgtgggtggtgaaggccacagttacccggtgagtagctgggctggactccacccttgctccctcctacaatcaacctcctgctcctcccaacaactttcctgaaaggaggcagtgaccactgtgcccttgcagcctccccggcaaccgacttctgaatcatcccactgcagagatctcattactgcagtgagtgtggctccagcctcccctcccttggctgctaatgagcgccctaatttgattgcctccaaatgagtgtgatgcaaaattaaaagatgccagaagacatgaccataaatccagtgagttggcttcaatttattatgtttgaattcaattagatttctcctccgatgttttccgaatatttatctagctgctggctacagaacgataactggaaggggctattactgtttaattccagcctcctccattcagcttgggctctggcaataccgttggatggaaaatctcagcctggatgtggggaggtcaagggagttcaaggtcagctgctgagccttctgccagccagccagcatatttcctgttggggaagggattcaaagcaatataccctattaaaatgttttaaaaatgatttttagtgcataaacactacaagggactccacagaagggagtgttggtgtcaaggcctttgttgtgtcacaggcagcaggggggatggggatctggggtctgggctcagcctggccacgaactttgtgtgacttgggaaaatcactaaccttttccagccttggcttctccatttgcaaaacgacggagttggactctgggaactgttttcagtggccctggattctgcactgctactctccttttagtttcagggtgtttgcccactctccttccccacccccacagccatgtgtcctgcttgaccctgggaacctgacttctttaagctgcctctcaggctttcttactgactgggcagaggttggaattagccagtgggagactctagctggaaggcaaaagtataggaagagagagagtggtcagtgtatccccccaccccgtccccactgcccctccccaaggctgtgtctctccaagacatcagctcctgctggaaaccccttctccacatctctagctcttactggctgtggcaacactattcctctctgtctagccccatgagtaacagcatcctagagttgtttgttttcgtgcttctcaacatccctgttcatcctcttcacctggccacacttctgtaaggactactgccattaaagtctcatcatttgaagcattcaatgccatttcttgccatgaccctgaacaatgcagatactaaatccatttttcgactgtggttttccatggagggctccccaggtctagaggggagctgagacaaaagcattcccggcttgggagcctgttgtgcagttggggaggtcccagagcaccaaggccaagctggggagacgttgtccctatgggcatggccaggcctccggcctcagggaggagagggagacggtgatcatggaggggaggccctgggagtgagaagctgggggaattgttccaccctgcccctccccccaacctccagagagcgaaagacgatgggatgtgggaggacggcaaaggggaagaggaagaggctccctgtcctgctgggtccttagccaagttggaagtgggagagtgagaagcccccatctagggtaaaggagtatgcccccaggggaggagagaaaggctgatgacacagagggctcatttgctctgaaatgggcctcccagtggaacagtgacgaagaggcagagtcagccgtggcggaagagcaggaaggagaggagtcccagagcaggatggagggagcatcagggagatgggtggatggccagggctggcctatggggcgatgaccaaaggttgcaggggtgggttcaggaatgagaccaatgaagtctcctgatttatggcttccagctttggtgtaagtcaatgacccgaatccctggagaagggtggggaatctgactctgaatatgtggcccaggagccctgcatgaaggagctggggcctgaagagtaactctgcattgagtactaggcttccaaatcagatcctggccagctgctgtctctgatggctcccagtcctcccctcagacccatggctgtaggccagactggcaggggcaagaggcaggagccaagtgggacatgtccagtgtcctggccaaacatacactggacgcagatgagccatatgcctgggaaacagagaaatggggtgaggccaggtcttcttgtgagaatgaatgtgccttactctctcctggagagagggtgatgacaagagttcattcattcattcataattgctttttgatttaagcaggcgagtttgttgtttaacaggctgggaacatctctcttttattgaaacatgtgacatagcaggttaaactcctaaagattcagcacagcagatgagaatcaaggagtttccttcttaaaaagcataacttgcatatgaatgaagatgattccaaattatgttttttccccatgaccctaaaattttatcccaaaaggagttatcatattagatattgatcagatcagcatttcatatcaaagctcaggacatccatctaaatatttaaaaatctttcactctcacagcacatcttgtgatcaatgtaaaacaaacagataggaacaaatcaaatatgagagaagggtttatggtgagagaaaacagtttctatcctctcccctccccagtcctggcctcactctccagaggcaacttcttgtaaacatttccatttttagtacttctggtgggtgcctccacaatgcttagtagcatgtataggcacccttatttttttattcatctggagaaaatttatctacctcctgtgatggaacataagaaatggcctcattatgcacctctgcttcctcccttcatccttccaaagttttatcattttggcataattatttttagttttctgttatttacttttaaaactttaaaccatataattgtactttgattctgcattccatccacctcagggagagtaacggtctggggcggtcaggttgggtctgttcccataccctccccttcttctgaaaggactctcccctccctcccgggggcctgtgcccatgaccagccagtcacagggccaggcatatgtcctgggccctggccactgtgggatacaggcatgctccccaatcttgaccactaggaatcctgcaggactttcactactaaaactgctctcttcaggtcacaacagtaactatcagttcaactacaccaaaggtttctgaagacaatggcttctccacccaagcaggttgtatataaattccaaatagaacttggcatcaccctgaaggaattctaacttcacactgttggggaaatttaccaagatagcttcagagtaaactaactttacacagcacattaaaacaaaagacatttattcagcgtcatgatcagactattacatttagcaatcaacagcatgggtgcaaaaaaaaaacctatattaaaacccttagctggaatgctttacacttcccacagaacagaaactaaaataacctgttatacagttagtcacaaatacagtcctcgagttttttgcccatacacatgagtatttgtctaaaacatgtcttctttgtagcagctaggccctgccaccactgtgcttggctgagttcacaaatctgtcgtaacctgtagattccctgtcatttctctggctctcctctcctgctaagctttgtttcctaattaaaatctgccactgccatagctactgctgctgctggaaccgccaatagccaccttggtttcatggttttgcaaagtataggcctccattgccacaggggccagagcttctgcctccaaaatttcctcccttcatgggtccaaaatttgaagactcattgttgtaattgccaaaatcattgtagcttccaccacctccaaaattgcttccatcattaccaaatccattacagccatccccactgccaccatatccaccaccaccacgactgccaccaaagccaccaagaccactgaagtttcctccaataccaaagttgtcattcccactgaaaccacctccacgaccaccaccaaagtttccagaaccacttcgacctctttggctggatgaagcactagccatctcttgctttgacagggctttcctaacttcacagttgtggtcattcacagtatggtatttctgaatgacaatcttatcgacggagtcatggtcatcaaaagttacaaaggcaaagccccttttctagccactgactcggtcagtcatgatttcagtcaccattaaaagggattacccaagcaaaatcatggaattattggttataaaagtaattgttggcacatcctatgtaacatatctaattgaataatggtaccagattaaattatagatgggaatgaagcttgtgtatcatccattatcatgtgtaatcaataaacaatttaattctcttgaaaaaaataaataaaactgctctcttttgttctgggattacctctaggaaggaaatgtaaagtcagctcttgtagggtgcctccaggcccctgacacgtggaaagatcgtgcaggagaaaaccaacccagaggtcagtggaggtggagaggaagttgtgagagagatcaagctgtggtggtgagaaaggcagctggtcctgctcactgaagcctccattgcttccggactgtcacagttacaccgacctgacaatttcagtattagcattagagaattgtttcagctttccaactaacacagggtgtattgtactccccacctcaggtaagatgagaattagcacgtaggctgcctgtgctagttttctgttgctgctgtaacaaatttccacaaatttatgatttgcttagagcaccacaaatcttagttctggaggccagaagtccagcatgggcctcacggggctaaaatcagtgtcacagggcagctgtgttcccatgaggcggctgtgttcccataaggctccgggtggagactgtttccttgccttttccagcttctagaagctgatggagttccttggccagccactttctccctccattgtcacagcaggtgtggcttcactctgacctcttctgcttctcccttccaccgaagggcccctgtggttacattgggtacacctgggggcttagcctgtctaatattgccacaccctcttgtgaatcttcttttttcttttctaagagatggggtctcgctttgttgcctaggctggagtagggtggtgtgacggtaacaaactgcaggcttcaattcctgtcctcaagcgatcctcctgcctcagcctcccaaagtgctgggattacaggtgggagccacagtgctaggcctctcatgaaccttgtcttccagaaatgtgttggactctcatccattagtaagccatctttctctcttttttaatgcttttcccttatagatttacttcattttaaatttataagcttaaatttcagtgatgatgtcttaggaagaacaggagaggaggaacaaaggaacaaacttctttaatgggaagctgaaaggacccttttaaaagtgtgcagtggagagatcctgggcttggtctctggtaaacctggtgaatggtgggttaacactccctccctcactcggtgttgctgggaggataagacagaacatgtggcgagcaggtgtccaatagctgcctcttgctatgtgcagccagtgccacatccaggctgagtgctgtggggagtgtggctcatcccactggggccacccctggcctcgctcactggagactccagaatcagggctgactgagcagcttgtggcactgaagaatgttctaggaaaggaggtgtgtcctccttggaaggggaagcttcatggtgggtgagctgagggtaaggggtgggtgagggccatttgaagagtcacctcccctacattcttttatcttttggagcctccatccacgccacttcaaacaatgaacacacacatccaagtcagtaagtgcactttgtgtatatctatataagtgatgcgcaattactgtataacagttcactagctgacctgacattattcacatatcgtaggcatgtgactaattgtaggtgtgtaatgaagtgttcacatcttattacatatttaattcctaaggcatttctacagttttatttgagaattttggaactgccagtgtgtttttcatgtttcaaaccttttcacaggccctgaaaaaacccaaaggccttatattctgggaccgtaatggacaaaacagccctgggaagtatgcttgggaggatggcgaaggctgggtttgctgagggaggtgccagctaaggtgctgggcacaccagaggcaagggatctggaccacaactgtcagtttgatgaacacactaatggtggagtgacccccaccaggagtggccagcaagcagggtccaacaggaaagacatctgggaggccagcaggtggaatcctggctctgccaccttcgtgctatgtgatatcagccaagttacttgccctctctgattctcaaatgctcggaggccctttgacctctagagtctatgggacctgagtgaccacagggctctggtttgttggtggctgcctctttatttaactccttttctcaaatacggtctatgggctttgcttaaagtgaggtgtcctgtgcacactcttctccatgactttgaggccgtgagaaggcccgccctgcagaaggactgaggaaactagtgctggagtctcctttcttgtatcagtgaaggaaggggagagaggagataaagtgctcaggttacagaatgtgaggatcgtgccccttttttccaactgaagacattcctaggcattttatctcccctgttgcaacttctaaatcacaaaaaccttatgcatccagtttggctgacatccacctgcaatgggagtgagtgagattgagccactcctcaggtgaatggaaaattaaggccaaccaaggcccaccccatgccccactgtggggtctaaaaggagcaggcactggcctgctttctttttccctaaagaaagctctttggggacccagcagaaacagcagaggtggggatgcgagcttccgcctgcatttgttccagggtgggccagtgaggatttgggaggaatggtgtggaaaggccctgcccaagaaggctggatgctggctggggaatgcccagggtgccagctccctaccctggggaaaggccaggctggcatatgccggagccagggtccaaggtcacagagaggccacacctgggcacccctcccagcaagggaaggtccaagctgggaattacttctctttggaaagtgaggggagtggtacagaaatagtgctattgttgctgttgtcctgtcacttctggcattggaaatggtgttgagcttctacgtgacgggcattggaggtcaaacctgaaacaggtgaggcccatccctttactaggctcacgttctaggtagggaggaggcaggtacctcctccacctaagaaacaacaagagatagagaatgcagtaactgtcctaaagagaaaaaccaggggatggagagagaataatggttgtcaggacgggtcagactttaggatggtaaatgaggagtggtctctgagaagggatgaggcagaggaagtgaggctcagggaagtgaagcacttgcccaaggcagcctgctggtcatggcagagctggcaagctcattccctcctcattatgtcaaccttctgggaccagagtctgggcagggcagaaactactgcaccaggggtgcgtggctccagcagagagagacaaagtgccccatgcaatccagaaactgagccctctgggctcaatcttcaaaggaatgactctcagagttgtgtcccctgccttttcttcaccatggaacttttcccagctccactctggtgggcttggggacaggacctgccctctgcaaagtgatgaccaaggataagtcggattttcaaggagaccttggagaacaccaccctcttattgtgcaaaagaggaaacaggtccagagagggtgagccattttttcagcatcacacagctgacctggagcagagtttcctaaaagctccctcggtgctctttcccctgctgtggctagacccctccacaggaacttaacaggaacccaaaggaacgagtcactcatggcagaatcactaatgtgatggagggcaggagtgagagacggcataatgtcaatgctggcacactcctggcacacgggaagctgtccatgagtggttgcttcccaccacttccatcgcccagtttgggacatgtctgagatccagtgctgagcccagggtctagcatgtcatgggagctcaggagttcctaattgactacatgaatgctaaggtgtgggatgtgctccttcctgctttctcattctcaaagaacactcttatacacctggttgtggggagggtatataggcaatcaacttttgcgtactcacttccattgtaggatcatgcatgcatgtggacgtgcgcacacacacaaacacaaatgcacacacacacacacacctgccttctcaaacttgtgggaccagaaaggatgctgcaaggcctaagataataattgctggtctcttttttcttatgctttagcaggaaaaacacactcttccaagcacacagctgcagaggtcttcctgagcatcatgtagtctttaatcatgttgtggaggacaggatgatctgtgcctcaggaatcagcttagttgataactcaattccatggctgggccccatttgtaagcagtcatggcacatcccatggaaacctataatctaattatggctgctgcatcagtcctcatccttcatgctgtcatccacagctcctcaccacccatcttacttggatgaaggctctctgaggtatgaaggacaaacatctgatccttccacttgaggcctaggctgctttccttattctcacagcagccacaagtattgggatcacagcttgaaaggctcttcttggtccgtgggactgaggcagtcaggacaatttcaggcctttagtgaatggaggcatttcattacttcagatctcacctagtcttggaggtcttgggcatttttagaactcacccagccaggctgccactcagggtgaggctacctggattgtttattggtaacgaatgtttgaatcagagaccgttagaaaaccaaaaatgaagattttaacaatacaaaaagcagaacctaaagaggtttaatcagtaggattggtaccagttctttgtatgtctgatagaatttagctgtgaatccatctagtccagggctttttgttgttgtcgttggtaggttttttattattggtttaatttcagagcttgatattggtctagtcagggtatcagtctcttcctgattcaatcttgggagattgtatgttcccaggaatttatccatttcctctagattttctaatttgtgtgcatagaattactcacagtattttctgaggatcttttgtatttctgcatgtatcagtatgccatactgttcaagcacatggactttgcagttggacattcctgagtacaaattctgcttctggcagagcatttaggtgacttagtctgctgactaagctgcagtatcttcatctgcaaatgaagatgaattgtaatatctttgtcatttctcacagtacttatttggaaattcttttttctttgttaatctagctagtggtctctcagtcttgtttatttttttgaaaatcaacttttggtttcatttatcttttgtatggatttttgcatctcaatttcattaagttcttctttaattttagttatttattttcttctgctagctttggggttggtttgctctttttctctagttcttctaggtgcaaacttagactgttaatttgagattgttttaacttcttggtgaaggcatttaacgttataaactttcctcttaacactgctttggctgtatcccagagactttgttaagttgtatctccattttcattactttcaaagatttttttatttctgccttaattttgattttcacctaggagttaatcaggaaaaagttgtttaatatccatgtatttgtgtagttttgagagatcttcttgatattagtttctatttttatcgcactgtggtccaagagtgtgtttggtataatttcaattttttaaaatttattgagacttgctttatgactcagcatatggttgatctgagaatatgttctgtgtacagataggaagaatgtatattctgtggttgttgggtggagtgaatgtctatgaggcccctgtagataaaataatagctgaaattagaaaaagaggtttaaccagctttactcatttaaaatgcaaatgtgctattagataagggccacatcacttggcatcaggccataagacaagatgtgtgtggattatcctgggattaatactcatttccaaacttctaggactattgagagttgttttttttttctagaaatctctgatggactacatttgttccatagttcagcctcatcatcttatgaactatttagataagggatagaaagtatcttttgaattcatgtcagcaccaatagattggtggtcgctgctttaaaaactgggcctagaaggattctgaattcttaactgggcttagagcgaaagaatgccatgttcaaagaagaaagttatcaatggctgcaggaggggtgaggtggcccatgtgtcacatgacttgctatctttgcactgggcaaccctaacctctgagagggtccttgttgaataagataagtaggtccagccctcaagttgttatcagtatagcagagatggtgagccacgaagtgctgccagatcactgtattgtgttctggtcatggcaggtgcatgtatcagtatgccatactgttcaagcacatggactttgcagttggccattcctgagtacaaattccgcttctgacagagcatttaggtgacttagtctgctgactaagctgcagtatcttcatctgcaaatgaagataatacccacctcacagggtagctggggtcattaaatgatatcagatttcaaagcattagatgctcaccttgtagtaatcattattactataattactgttggtgtggaaacacagacacgcctctaaactgtcctgggtacagagaagtctctacagacaggccctgttttaaattgcaagtgatactcaggcagtcttcagtagacaaaggcagaggccattcagtgcaggggaggacattctgtcccctggttaggaaacctgaactatggaatagaaaaaaacttagactcaatattcagaacaactttcctgaaataaaggaagacttgaattttctgaccgaagggtaaattgatttagagaagtcaatgctgagatgacagatcctaacaaaatgaatgtttgccttcaaagaaaagaatcctaggagtatccagtagaaaaccatctctccaaaaaccaatcaagacaacaacaaaaataaaaacaactaccccaaacaatcacatgaaaactcaaaccaagagaaacacttgcagaatgtcagaataaggacttctgaaaatccttccttaacaacaatgagagcactggcaaaaatgtcaaaattaacattttcagagtcctggaaattaaccaaaggctttcagcaatccaagttagatttattcaagaaacacagctgaatctcagtaagaatagcaaattttgtggtgttttaatttgccttattcgtagtcttcttttccaagctctatgatagacttgaacataaatgttctcagctaggcatggtggctcactcctataatcctagcactttgggaggctgagatgggaggattgcttaagtccatgagtttgagaccagtctggacaacacagagacaacctctgtctttacacacacacacacacacacacacacacacacaattaacattctcacaaccatgacagctgtgaaaaccagcagcctggtagccactggggaggacagaataggtttaaagctctccaaaaatcccatcctcagaaagttgttactatttgatctgtctgacagctccctggaaaagacacattcccagggattgtctttgcttaacatggtttggagcttagtctgtgtgaacagccctatcctgagggaatctgtcaaaaacaatcagcaaaaattgtttgacattgcaactgcctgagatggcagtaccagttggggctaataagaggctgaccaaaacagttacaaggaaaaactggggaatgaggtattcatagaggctttggaaaagctctgacatattcttaagaacctagaaggccatgtgcacgtgcagggttgtacacatgtccaagacagatctaactagagcttaacttttgtttggctttgaggctctgtgcaagcaggaagtaaactctgaggcagagttgtcagctgcttgctgaagcatcgaaggcatggctcaacacaaacaaagcttcccagcaaaggtaggtagatttagttgtgcaaggaatttaaagaaatctctgtccaaaaattaatggacaactaaactgaggaaagacttcggtggctacacatgacaaaaagtatacattaaaacttagtccaggaaattcactaaacagagaaacagcagcatcagcaacaacaacaaacagaagcaacaacaaattgtgaagaggggtgaggtctgatttttggagatgccacattattttatttaaaacattcagtttttaagaaaaaaatatgagaaatacaaagaaacaaaatgtgtgacctattcacagggaaaaagctgccattagaaactttttcttgaggaagcccagacattggacttactatcaaagattttagaacaagtcttaaaaacatgtttaaacaactaaaggaaaacatgtttaaagaatgttaaaaagcatgacaatgatgtcttaccaaatacagcatatcaataaagagatagaaaattatataaaaaagggaaaaaaataaaattctgggttgaaagtgcaactgaaataaaaaattattaaccagaggggcttaacagccaatttgagcaggcagaaaaaagattcagtaagttgaatatgggtcaattgagattatacaatccagggaacagaaagtcaaaagaatgaagaaaaatgaacagagcctcagagagcataccaatatgtatataatgagaatcccaaaagaagaggagataaaggggcagaaagaatatttgaagaaataattgccataaacttcccaaatttgatgaagaacattaatttacatgctcaagaaattcaacgaactacaagtggtataaaaacaaagaaatccatacctagatacatcagagtcaaactatcaaaagccaatgacaaaaagagaatctcgaaagctacaaaagaaaaataactcagcatatacactctagcttcaaattcctcaataagattaacaactgacttcttatcaaaaccattcaggcaagaaggcaatgggataacatattaaaagtattgtaagaaaatgactgtcaaccaagaattctatatctagcaaaggtatctttgaaaaaaaagaagaaatgtccagataaatgaaaaatgagagagttcatcatgagtagatcttccctacaagaaatactaaaaggagtctctcaggctgaaatgaaaggacactagatggtaacttcatccacacaaagaaataaagagcactgcagggtaattacataattaaaaagacagtataatgtatttttaattgtaattctcttcttatcctatctgatttaaaaatagctacataaatgagtaattataaaactgggttgttgggcttataatgtataaagatgtaatttgtacgataatattaacacaaaggaagggggcaggaaatggacctatattgaagcaatctttaaatatattgttgaaattaagttggattgatatggattagattgttttatgataaaatgttataatccccagggcaagaataagaaaataactaaaaatatatggtaaaacaaacaaaagaattaaaatgatatgctagaaaatatcaattgaattcaaaagaagacagtaatgagggaaaagaaaaacaaaaaagatgtaggacatataaaaatagcaaaatggaaggtgtagagcctatcttttcagtaaatcatattaaatgtaaatagagtaaacataccaatcaaaatgcagaggttgtgattttaaaaaatgaatcaactgttatctataagagacatactttacattcaaagacacaaataggttgaaagtaataggatggaaaaagataatccatgaaagtagtaaccaaaggggagctggagtggctagttatactaacagtagaccaaatagactcttaagacaaaaattattacaagagacaaagaaaaacattttataattgtaaaagtttcaatctattaagaagacatggcaattaagaatatatatgcacttaatagcagagatccaaatacatgaagcaaaaactgaagtgagaaatagaaaattcaacaattatagttggagacatcattactccactttcaacaacggatagaacaactaggcagaagatccacaaggatatagaagatctgaaaaaaacagtaaacccactagagctggtagttacccacagaacactccaccaccatcaacagaatagacattctttatatgtgtatatggaatgttctcaagaataaatcttgtcatgagaagaatagtggcccccaaagatatccatgccctaatccctggaaccacgttacattacatgacaaaaggggctttgcagatatgattaagggtataaaccttgagatgcggagattaccctggattgtttgggtgggcccaatcaaaatacatgagttcttaaaagtggagacactttcctaaccatggtagggagatgaaatggaaggaggaggagacaattgaggtgtgagaaaggtttaagtgactactaaactgatggacttgatccaccattgctgcctttgaggatggaggaaggggactattaataagggaatgtgggtagcttctagaagctgggaacagttcagctgacagccagcaaggaagtgggaatctcagtcctacaacttacaggaactgaattctgccaacaactcgaatgaacaagggaactctccgagaatttccacaaaggaatacaaccacacagattcctatttttagcccagtaagacatgtcagacttctgatcttcagaaccacaagataataaatttgtgttaggtgcaaatttgtggtaatttgttatggcagcaatagaaaacacatacatgtatattcatccataaaacaaaatgcagtaaatttaaaataattgaaatcatatagaatatgttctctaacaatagcagagtgaaattcaaaaccaaaaacagaaagaaatttcggacatccacaaatatgtagaaattaaatgacacactccaaaataatcaatgggtcaaagaagaaatcacaatgaaaattagaaaattatttgaaatgaatgaaaataaaatcacaacatatcaaagtgtatgggatgcagtcaaagcaatacttagggagacttttatagctgtaaatgcctatattaaaaagaagaaagatctcgataacccagacttccaccttaagaaagtagaaaaggaagcgcaaactaagcccaaagcaagcagaaagaagaaaataataaagattgtagtggaaataaataaaacagggaatagaaaaaacactaagggaaaaaacaagagtaattgcttcactgaaaagagcaataaaattagtaaacctttagcttgactgagaagaaaaaagttatgtgccctatttcattccctatacattaaattattaaattattaatgtatagggaattaaattattaaattaataatgtttagagaatgaaatagggcacatcactaccacctcatagaaataaaaggattataaaggaatactataaacaattgtaagacagcaaaattttaacttaggtgaaatggaaaaattcctagaaagacaggaactacaaaaactgaatcaagaacaaatagaaaatttcaatagaccttagtaagtaaagggattaaattagtaattaagaaactcaccatgcacaaaaaagctcagtaccaaatggtttcgctgattagttttcccaaacatttaaaaaagattattgttaattcttcacaatcttttccaaaaatagaagaaacaaacttcaactcattctatgatgtcattattctcatgataccaaaacaaaagacattctaagagaacacagcaatatctttcatgaatattaatacaaaaattatcaacaaaatactagcacactaaacctagaaacatataaaaatgattatgtatcacaatcaagtgaaatttatttcaggaatgcaaagttggtttaacataataaaataaatctaattaatacaccacattaataaaatgaaggataaaatccacctaatctcaatagatgcagaaaaaacatttgacaaaatcaatatcctttcatgataaaacactcataaaactagaaatagaggagaatttatgaaatctaataaagaacatctatgaaaaaccacaactgacatcatcccaaagggtgaaagagtggatactttccttctaagaccagtaagaaggaaaggaagtccatgctcaccacttctattcaacattgtattagagatctgagctagggcaattatgcaaataagtatgtaaatttaaaaaatagcatccaaattgaaaagaaagatgtaaactatatttacagatgacataatctaaggaattcacaaaataactattacgactaataaatgagttcagcaagattgcagatacaagaacaatatgaaaaacaattgtatttctacacactagcaatgaataatctgaatataagattaagaacagaattccatttacaatggcatcagacaaaataaaaggcttatgaataaattcaacaaataagtctaagacttgtacgtactgaaaacaataaaacaccactgaaggaaattaaagaagacctaaataaatgaaaaaacatcctatgttcatggatttggaagacttaatattgttaagatgtcaatgtttcccaaattggtctacagattcaatgcaatcttgattgaaagattgtgtgcctttttctcagaagttcacatgcagatgcaagagacccagaatagccaacatgatcttgaaagagagaggactacacttcctgatttaaaaacttaatacaggttgggtgcagtggctcacacctgtaatgccagcactttgggaggctaagttgggaggattgcttgagcccagagtttgagattaacctgggcaacataatgagaccccatctctacaaaaaataaaaaaagattagctgggtgtggtggtgtgtgcctgtagtcccagcaacttgggaggccgaggtgggaggatcacttgagcccaagaggtctatgatgcagtgacctatgatcaaggcactgcactccagcctgggcaacagaacaagaccctatctcaaaaacaaaatgaaacaaaacaacccccccaaaccccaaagaaaaccaaacttactaccaacgtctaggaatcaagatagcccaatactagaaatgtaatagaattgaaaatccaatattaaaccttcacatttatggttaactgatttttgacaaaggtgtcaagacaattcaagaggattaaaaaaaagccttaacaaatgatgctgggccaaccggatttccacatgtgaaggaatgaagctggacacttaccttacatcatgtacaaaacttaactcaaaatggaccaaagttctaaatgtaagagctaaaactataaaaccatagaggcaaatgttcatgaccttggattggtaaaaggattattagatataataccaaaagcagaagtgaccaaacaaaaaaaaataagtggggcattatcaaaattgacagcttttgtgcttcaaaggacaccatcaagaaagtcaaaaagcaacccacagaatgggaagaagtatttgcaaatcatatatatatacatacatatatatatatatatatatatatatatatatataaaatttgataagccacttgtatccagaatatatgaagaactctaacaattcagcaataaaagacaataacctaattaaaacatgggcaaatgatttgaataaatatttgtccaaagaagatatactcatgatcaaaaagcacctgaaaagatgcttgacattattagtcattaggaaagtgcaaatagaaccgcaataagatacaactacacacccattaggatggctttcatagaaaaagacaggcaataagaagtgttggtgaagatgcagagaaattgaaaaccccgttcattgctggtgtgaacataagatggtgctgtcactttggaaaacagtttggtagttcctcaaaaagttgggtgtagtattatcatatgaccaaggaattccactcctagatacatacccaagagaactgaaaacctatatccacacaatatcttgtacaagtgttttcaaagcagcattattcataacacccgaaaagtagaaacaatccaaatgtccgtcaacgaatgggtaaacaactgtggtattcctttccagtggtaagagacagaattgattagggaaatgaggcagattcactaaactccactgaaggatggacctgagccaacagttcacaggaaaatgacacaaaaggcctttaaatatataaaaagcatcatgtttaaagcttcacttgtcatcatgggaagtcaaactaaaacactgaattactatactttgtccaccagatgagtgaggatcaaattttgaagatgtactgtcttagtaagaggtttaggaaattggtattttccttctgtactgatgagaatggggacttcttgacaaaatctatcttaagtacaattccacatgccctttgatctaaacacaatattttaggagtctatcctatgatgatacaaagtaatataagaatgtttattgcaataacttccaataacaagctaccgaaaccagcctaaacaaccaaaaacagattaaatgagtagagattggttaaataaattatggtacattcacaatgaaatcttacactgctgttaaaaagtattaatttttcctaaagatatattaaatacatataattaaaaatagaaagaagactagcattagacaaaagctagagaagtagggaaagtacatatatttttgcgtattcctagagaatttctagaagcatatacaggaaacttaacaatcgtgagagagtttggagaggactttggctgggggttctggagtggtgcagagatttattttcaccacttactcttttgtactacttgattttctagaagcatatgcaagatgaatttctagaagcatatacaagaaacttaataactgtgagagagtttggagaggactttggctggggtctctagagtggtgcagagatttattttcaccatttactcttttgtactacttgatttttatcaagtgcgtgcattacttttttgccttttaggtttttattttatgcatgtttagacttttaaattttcaaataatcatagattgacaagaatttgtgaaggggtcccaatatccttcacccagtttctccactgtttacgttttacattctacaaaacaatatcaaaacaaagaaactgacattagcacaatgtgtgttcttctattacattgtatcacatgtgtagattcctgtaaccaccaagacacaaaactatcccatcatcccaagatctctcctgctacctctttgtagtcacacttccccaccaccgcctctaacgcctgccaaccactaatctgttttcactgtttataattttgcccctggaagaatgttatacaagtgaaatcgtacagtatgtgactttttgagattggtttttttcacttagcctaatgctcttgagatccatccatttagttatttgcatgaataatgtttctttttattgctgaatattggcatagatgtgtcacttagtttaagcattcacttagtgagggacattttggttcttttctagtttctggctatgataggaagacacaggagaaaatcatctggacctaggagttgaggatgagttcataggcatggcacccaagtacgattcattaaagaaagaattgataaattggacttcatcaaaattaaaaactttgcctctgcaaaatattctgttaagatgatgaaaggacaagctatggaggggagaaaatatttgcaaactgcatatctgacaaaggactcacatttacaatgcataaagagctctcaaaactcaacagtaaaaaaaaaaatctgataagaaattgggcaatagacatgaagagacatttcatggccgagtcaaatcagcatgtggaaatatatttaacatcattagcctttggggaaatgcaaattgagatcatgagaaatcactgcacacttatttgagcagttgaaacaaaaatataatgataaaaccaaatgctagcaaggatgcagagaaaccaaatttctcatcccttgcttgtgagaatataacatgatacacacagccactcccaaaaatagattgacagtttctcaaaaaacatgcacttaccatattactcaacaatcacattcctgggcttttatcagagaaattataatttaagtttgcacaaaaagctacacacaaatgctcataactgctctattcgtcatgtttttattggcaggtaatttacatacaaagaaattcaaaaatcttaaatttcacaattcaatgtgttttgtcaaatgcctgcactcctgtccctcccccactgtaagatttacaacactctagcacccccaaaaagttatttcatgcccccttcagctaacctctaccatgccactccatccataaaccccaaagcaactattaaaaaaaaaaaaggcaaaaaacgcaattactttcgcaccaacctaatactagtctgatttttaaatcacagattcattttcatataaatggaatcatacaatgtttattctttcatacctgacttctttcattcaggaacacgattcagagcttctgctgtgcagtagggggcatcagtagttcattttctttttattgtctgctaacattccattgtatggattcaacctagtctgtttattcattcttcttactgatgaagttttttttttctcacggcttaagtccaaggtgtgtctttttcatccagccaggtggccccggcaggtcgctcctcagggacccacatgggtcagggcggtgcagcagtgacccacaggggccagtgcagttgaagtggctttgaaacctgattggagaaacagactgctcagctgttaagaacacacagcgctccagaaaactggtgttcaacacaacgcgtcactccggcttccactgctgctgcggagagtcaggttctccggcaaggccccgcgcgcccgcccccgcgcgcccgcttctctgtccagggaacgcctttctgcggccggaggcggctacgagggggcgctgcgaaagcggatttccaggcacgcctggcgccactaagcggcgctgagacggcgctgcctcctgactgccggttggaggctacaggggctctggggcaagggccgcttttaggagtttgctggtcacgaggggggacgcgacctcgtccaagatctgtctgcaagggacccttcccagccgatgtgaacacagcccggggaaaggggccgtccggggagcacaggcagcccgggaagaggagtaggggctgaaaccaaaggcagcctgggtacccaggttttcccaggggacaagtcccccggttagctgggcacagggaggcatggagagcggcagcaactgcgttgggatggggcggctgccccaggttggggcggtgacccatgttccaccaggccaggcgcagggctgaggtggccgactcctgtttcacaagtgaagacctggttaccccagcagcaaggcattccggagtgggagaattcctgagtcctggggaggaagccgtggttacagggctgtggccctgagcaggagctggctggcccagcagggtgggccaagcacttcagtcaaggctgagcgccaggcaccagggactcaggtctgagagacctgatgtacatcctgctccagagcagatcacagagatgtgcccgcatgaatccccaggctaagcccagaattccgtggaagatgcccatgggccaggaacacgggtagtcaccgcgctagggcatcacacagggccccccttggccaaataccacgagggaacttagacacctgcatggggccatggaagtgcctgcaacctcacactcaggcctagggcttaccgaggtattgcagatatttgtgttctcagagtaggagcttaggaatcagtatcttctcttcactacagggacagagatgcagtggcctaggacacatcacaaatatttaaaacgatgtccttggtcaaggacagaggtagccaaggccagccttctcccaggaaactaacccaggaccccaaagcacagagctgttaggtgggagggaattggtctgtatgtctccctatagtgttgcaacacttcggcgctgggctccctgtcccagactcaccttccatactcaagccagaggcctacgaaagccgggttaagatcttcccctgcctgtccctgtaaagcttccccactgtctctggaaatcgtttgagcttcttagccccacagcatgagcccgctctgactcaggccctgacaagctctttctcttctgtctctccctcctctgttgatatggacacaccattcctttggcatgtctagtacagaccagatcccctgctgttgttagcattcctccctctccctggaatgttcttccttatctgtctacctgataagcactgagtcatcctgcaaaactctgcacagctttcaccttccctgaggagcctcccctggccagccccaccctgttgcaggcagaatgcttggcggtgggttgctgaccacaaatccattccccctttattccttgccaagggaatgctgattttgctcaggttgtcaaccctcagggaggtgaccctaaacatgccaagtccaacacactagctctaccccctgagagcatgagaacaacacggatgggcatgtgcccggatctggctttgccctcatggactgcaggtcaggggtgggaagctcttatagagcagccccaggagccctaggggccatcctgctggccatgccatggcagtgtcagaaccccaaacagcacctggggtgaaggagctactgaaagagtggagagactccactttgtcctgttagatctgtctcagaagtatttttattaggattgactgggtaagctttcttccacagggagcctaagggggcccagagattcttctcagaattggaggccatcaaggattggctcaggctcgctggctactaggctctcctgttcccaaagtccatactcttgtttgttgttattcaaaaatatttgttgaaagcctgctatctactaggccctgaatgtttaaaaacaaataaagttcctgccttcaaggggctcacagcttttctgagaggacacgtaaacagataaaatgtcattagggtgtagttctgtgtaatagagggtgttcttaggtgctgacaagagcatctactctgtagtttaagcagaaaacaaatgtatgaaaggctattggacggctcacagaattctgtgcggcacgaacactgtgtctcaaatcatgctgcaggacaaacttggggctcagtatgctggaccatgttgtgccttctctcccagccagtgctgcaatggaagaaaaggaattcagctcctaggaaatgcaaaacattgatctgaggatagagaaggagtatatgtagatatcatctcttggagggaattaaaaagcaacgatgatagagctatggcaaggctacaggtagggaatacctatggcaaagaaaaaccagagctagacgataaagtagtaaaaccagattttattcaggactattgcaataagcgaaaagagacctcaatatacagtcaggctcattctaaaaacagcatgagaagttgagacttggagccatggagcaggtaggagttgaaagatggaaaattaccaagaggaaatgccaggggtgagggtgatgttggctaaactgacctaacaggagacctgctgaagaaaggccagggtgaccagacatcacctgggaaggtggaggatgaggaccctgatcggatattgggagtggtcagataggaacaaggggagttcttgctgaattgacttagtgggattcttgctcaaattggattttacaagaaagtacacagatgagcctagaaggttcaggagcctgactcaagtttgctcaagcaaagaaactttgtcactattcccttatttttcccctatgctgaaattaaactgggcagactccaaattatctttaaaaacataggtgtgtttttaacaaattccaaagagcaattgcaaaagcacctgtggagcgtgtctgctttaccagaagtgcccaaaaggttactccagcaaaaatgattagcaggtgctgtggatgctgctggtgtcctggccagggcccctttgcttccttccccaggtgccatgggggtcacctggtgggagtcagcacatggggccgtgaccccttacacccatgctgctccagctctgaccccaggcagagagagcttcccctctaatctgaggagacctcttgcttccaggcctgtcccacatttctctgctggcagggaggcagtgggggtgatgtccattctgccccatcaggggagatgatcaacttcatgactctgcttaagcagatccccttgctgggcatgtacttggacttgaccaaatttccttggctgcagctcttctcaaggctcctgtttggccacatgaggcctgttttggggtgggctgcaaaagaacccatcgaaccagtggtcaggggagcttgcagggcagagagatcctctaagtccttccttccttccttcctttctttcttctttcttttttctttttttttttttttttgacagagtctcgctctgtcacccaggctggagtgcagtggcactatctctgctcactgcaatctctgcctcccgggttcacgccattctcctgcctcagcctcccgagtaagctgggactacaggggcccaccaccatgcccagctaatttttttgtattttttagtagagacagggtttcaccgtgttagccaggatggcctcgatctcctgacctcgtgatctgcccgcctcgttctcccaaagtgctgggattacagactgagccaccacgcctggcccctctaagtcctttctaaagagctttggcagaaagcagctaggcaatggctcagaagtgaaagcaagtctgcacacaaagcaggacttgaactgaaagaaaaggaataagaattctcacccagggctgggatccaagagacgcacactgatacaactactaaaaggttgttaaactcccgaagggcccctgccttgctgtgttatagtctgattgtgtattgttgaagcccttacccccagtttgctggtgtttggagatgagcctttggaagctaattagggttagatgaggttatgagggcggggccctcatgatggtatagtgatcttatgaaaagagcaggagagagagagagagctcttccccccgtgaacacgtgtaagcacagaggaaaggtcatgggaggacgtgtcaaaaaggcagccgtccgcaagccaggaagaggccctccccaggaactgaattgatcttagacttcccagcctccagaactgtgcaaaataagtgtctgttatttaagccacctatttatggtattttgtatgtcagtctgaaaagactaagacatgttggtgaatagctgctgcacccccaacacccaggagcctcccctggggccccacagacaccctgccatccagcactaagggttgaggcctggccctgcaggggccgatactcgagctctgctccacccctgcagacagcagccattcaggtgagtgggttgtgctgcaccagttgttaaatattctgagcaccacttgtggtggatttaaaaacagcccccagattcgttgacactcttctcattgacagattgggtctgtgtcccctttccttgaagctggggtggcttgtggtgtcttcaactgatagggcaccggggaagtgatgccatgtgactcctgacgctaactcacagaaggcaatgtggtgtccttcttgtccactgggagacggtggagccctaccacttgctaccctgaggccaccatgctggagaagctacgtgtaggagcgcaggggacagtcccagttgagcctggccttccagccatctcaccaggggcccaacatgtgagtgaagaggcatccagatggttgcacccctctgccctagagtcaccccaaccttcaggtcttcccaactgagactgagtcgtcttacttgttgggtcagagacaagcaccttgctgtgccctccagaactgctgacccacagaatctgtgaacattatacatgaggattttatgctactggctctggggtggttcgaaaggcagcagttgtaactgggagcccaccctgtatagaaatgtgaggaaactgaggctcagagagagagtaagtgactcagtcactgatatagtttggatatcccctccaaatttcatgttgaaatgtgatccccagtgttggaggtggggcctggtgggaggtgtttaggtcagggggcggatccctcatggcctgatgctgtcctcaccatcttgagctctgacaggatctggctgtttaaaagtgtgtggcacctccccccacctctcttgctcccactctcgctacgtgatgttggctcccccttcaccttctgccatgactgtaaggtccctccagaggcctccccagaagctgagcagatgccggcaccatgcttcctatatagcctgcaggactgtgagccaattaaaccccctttttaaataaattacccagactcaggtattgctttatggcaacacaagaatagcctaacacagtcaaagtcatggagctggtgcagggcagagccagaatctgcctcccgtccaagtgaattcagagcccacgctattcccatctccctgatcaggctggttcctgggcacacgcttacccctcagggccacttgaggggaagtttgcaaactggagcatgttcaggggtgatggccccaaacaggctccaggagggaccactgaagggactggggacactgggctttgacagaggtcatcacagaatttgtgggccttcttcagatatccaaaatgttgttactgggagggaataagtgttgtggccctagatggcagaggtgtgggcttgatgcggctgattttggttcaggtaaagcaagaactttgctggtcacatccattggaaaaagattgggctgtcaaaggacgcagtgagtcccatctttggaggcagccaagtgcacccggagtactcaactgcaccctgagtatcaccagtacaccctgagtacccaagtgcaccccaagcacaccaaggaccacccctgggtggatgccaagggggtagtcaggccacaggttggaacagcaccagctgactttaaatccctctctaaccccgagatacaaggatgtagcctacacatcaggaggtgaatagaatctaccctcatttgcaagagttgtccccagggcagcggtggctgcagcccatccagtgttcccactgggagatgcccacgaggtgctcaggtacagcccatccagtgttcccactgggagatgcccacgaggcgctcaggcttcgtggctccccaaagctctgtttctgacaaattaaattggtcctacactggtccctgctaaacatccaaagatactttgagttgaatacaaatctttattattttgaaaaccacagcaaaggcacttcagaatctccaggtacccagtctcagttgccgttcagtggggacaagagtggtgctgagggcatggtcacacccttctgtgctgcatgcagaggggtgcaaggccagggcagctgacctggtcagccaccaggggagcccacgcctcttataacacagtgtccttgggtcaggaatttgtagtttattttgttattaagatggcgagagaatttttcgtccatttagagcctaacatttttagatgaatgttaatggcatctcggttgggatggattcgtgttcgtttctcagctgctgaaggatgtgtgttctaaaacaaaagggctcccagccagctctccggctgcatgatagagaagtgttttgtaagacgcttgttaaaaacccatattccctggcccctcttgtggagaccctgtttcagtagatgggaatggggctggggtctgtataacctgtgcccaggagactctgtgaccagcttgggaagctcctgcagggaggaaggaatgatccacaagtccccaagcccttcatgctgaggcatctgtctggctggagaaacactaaggttggcattgtgctcacactgggaaatgacctggaggaagttgggaagaggagtccaggccggttccaccctctgggtcagaaacccggctggaaagcactggaaatagggaaatagaagactgaaaggctgggacccccctcacacccaacctgcgtccatggccgaggttgagtgaggagtcctggagactctggcttcatggtctttgctcttgttcttctgtgcctcaggggtcgctgcccaccaggctcagcagggcgttcttgtagtcgccgctggtgtcttcctgtgggcaggaggcgcataagcgtgagaaggggtttgcttgtgcctggctcggcagtggcggctgtgttattatgactaagaggtgtgcccctggcctgcacctggcccggccctccagggttcctagccgcaggggttgtgccatcacccctctttcctggtttttaatttcaggctattcctttacatttccttttgattctcttaccaactacatgcaggattgatgtggaaaatgaatcagagacagttccactcctaaacaaggaaggggtcagctgtcccagggttcttctattcgggagccagggtgcccagccattcatttacacaacacgatgcatcattattcaacacctgctgtggcagcttgggaatcaaggctgagagtgaggcatcagcacacacctgggggcagggccgggggtggagggagcctggatcatcgcaccctgacggtgtggccgaggcaagccccttcacctctgtgggactcatctatgaaatgagatcgatgctgtgctgctgtgcatcttgctgagacgtggtgagggtacagcaggaggaaggcgagctggtctgccctgcatctggctcacatcgggtccacagtgtttgtctcctgatgagactgaccttgtggtccgatgactgaggagccctgtttcttagatactggtaggtcctgatgggactggctagtccggggtctgcatacagagctgggaaatgggccaggtcagatcacccagattcttcttcatgcagttgaggacagcggggccaagagaggggagtgaattcattcacaacggcatggtgagtaaggggtagactggggctagacccactttccacactctggaccagtttaggtctcatggttattgtctacttttcaccatttagtaaaatttgcctgctttgagcctgaaatctcattacgggtttcaaactacaatgaaatttttttaactttttcctttctagacacggtctcactctgtcacccaggctggagtgcagtgatgcagtcctagctcacggcagccttggactcctgggctcaagcgatcctcctgcgttggcctcccaaagcactgggattacaggtgtgggccactacgcctggtgatttttattattttgaagacaatttttctaatagtttttagaaagaaaagcattaattttgtttactttttcaaatacatgagttatacttggagtgtttatacatttgcctcttaatttcaatgcaggagtttttaactcatattagtgttgaaaaccatttttgctttaatgacatctgtggtctacactaaaaagaaacgtttggtcaatgtattcatgattctaactcaattttcttaagtaacaacattagataaaatttgaagagggtggcttcatgtatctgtagaaatctctctgatgccgtaagttaccatgtgtggttaaaagggttaatgacaatcagctcagactgtctgcaggtgacagcacagtccaggctggtgtgtgccttgccctcctgtctcccgacaagattggctggggagcctcaagtgaaaccaagaataattccaatcctctcttgcccctgcccacctgtttcaagatgttgccatcttgaaacatctggaaacagaaatgtcttttccacctattgtcagctatgtgtttcttgaaaagtgcacttaacaacgacatttgcagaagagctagagacttgacttagtagccaaagaaaacttggggatacatttgtcctaatgtgacttctgctaatgaaatcatcaagacctcaatttgcagacacccccagaagagctgtttctcccaattatcgcagcgtgataatcagtctgtgttttgaaggctccagaacttttgctaattggaatctggttagatagtctattggcgctcatctgacttatctccttagaagttggccgccaggactacttaaatctggatttgagcggtgggcccgattcctaccggactagttcatctcattgactattcagaggtggcttcttctgcaaggatttggtgtcttttccaaggagcaaccataacttaaatgtgaaaccaactttctgagtgggacacaggggagcctctgtgccctggtctctgcatctcccctctgccccccattccccttgggatccagccacactgacctctgctgttccctgcacacaccacatggtcatgaatgcaagcacatggtgcccactgggaagggaggggctcacgtagtgttggccacagcctccaggtttccctgaatgtctgggtttcaggctggcctcagcattgggaatgcctgcttaccatgatcatgctgctgagggtcttgccgtacatcttcttgaagtgacatttgataagatttaagtcaatctcgctccttgaaacgatgtttcttatcagggtcccatcacgcgtccctgctccctgggcaagacagcagccatcaacaatcctgcctcacctttcctgtccatctctgagtgatggacggatctgtgtggttgggttctggggcttttagagggagggagatgtgggaaggagcctgtgcttcagccagggaagcattaggagggaagctttggtggcttagggtgtccactcccttaattccttctcacccactgcccagaactcttcctttatgatgccaagtgctccaaactgcagtatgtttggtttgccacatcagattctagacacaaaatactcactgctccaggaacaagacttcctactagagcaatggcagcaatcagctcagccaggaatttcacaggcagggccttcctgctcaccttcatccctgaccagtctcatgtcagctggggccacatggccaagggaatcgcatgccctctctcatttcctgggcagaagtggccagagggcttgggtttcgggtgtggaactaacttcaggggatatcagcaaccatcaatcagagaaaacgggcaatggttttagtttcagggaattattcacctctggagatgcagcgtccctttcccagactcaatttcacctccgagaactaaaacctttctgatccacgacaggtttgggtaagataactcccccgtgtggaggatcgtggtggctttgagctccttggctttgcacttggtgctatgtagggtgagcgtcaggaagaagaagacaggacagttaccttcatggcatagtagagtctctctgcaaagtagctgtggaggttttgggtgcatttcactggcaaacaagaaagctgtgttaatgtctggagctggtaggtggcactgcctacaactttatgtcttgccttaggtcttaagagtcagtgttgtgcaaggcttggcatatttctttgttccgtgcctttcccaatgtgagaggctttgtgtcaggtggcgtgggacagggaaggtagcccggggcactgggcacagctccaaaggcccaagcaggcaggcaaaagggtaagatgtgaaatgcaccagactgtggggctcgtctgaagacaccagctcaagcccatccaagggcagctcagactcaggacaggccctgggctctcaacccagagacacctccaccaaaaatccagcctctcagctccacagaagcaccatgggatggtggctgctggcctcagagtgccctctctctcacacttatcagcaggaaccctgcattttgaattcccatgtgacaagtggagtttggccccacaggactaaggcacctgggggcgtctggtccagagactgggcccatgcttgctcccatgggtactgctcagagacttggcatctgggtggggaaggttggcattttcacttagggctgcagaaggagcatgggctttgagtgaggtaggcatgtgttcacttcctgccttgatggtgcagtatggcttcattactcaacctccctgactcatctgggaagtgagactgatgcgaggcttcaaggtgaagtgaataggaaggcccagcatgacggagcactgcatggcttcactattccctgctggcagacttcattcttggtgggttcaggccagatccaggggtggaagctgagattggagcaggggtgtgattagatgtcctgacatagaccggattgtatcacagcatccaaggccagctggggtgtctcagatggccctgtccacccagagaggctaggaaacagcagggagcctgctggctgctggctttgcacggaggcagcctggtgtggaggtgagagctgcaggccaggagtccggacctgggctctgtgtgtaagtgggagaagagacgtccctctgccctgggcctcagctctttactctgcagtgactcttcccattgtgatctcagccctggaacccatgagagctctggagtgggtcctcctgagtggccctgacttcctgctgtggggaagatccccagtgtttctcagcatcagaccatccgtcactcagtttggactcaagccacacatcactgtttcttcaactggcaatgaaggcaggggccaggcccctggttcatgtccagaaagatgactttgtgctggccagggcttcacaaccacagccagagtgctccctgcatggctgccatgagtacacacagggttggggctggcataatcactggcgtatgcatttgtgtgcgcacacacacacactgtctgtctcacacacacacactcacattccacccacagtcatgcacacacaccctcaggcacacacactctcacgcacacacacactcatgcagacacacccacacagcactgggcaccacgtgggcagcacagagaacaatctttggcagcacacactgggactctagaggtggagcagtccctgggtgagggagacaggcagagtgtgagtcggggggacatcccgtgaaggtgacacagggattctttctcttgtggtcgcatccctaggccctttgttctttggtgctgccccacggtgagccctgtggcctgaaaaacgtgcaagtctgagctcttacccacagtgagcatggcctcctccagtgagccatgggtctcactcttgatgctgtcctcaatgctcttgttggcaattttctcatactcttcaaacactgtggagagggctctgctcaggggatggtcagacctcctcgtgatgcccctcagtgtctcggatcagagatcgcacatcaatttgccgccctgacctcccactggtggctggggaaacagtcctgggctccctggctctctccctaactctagacttgacaaggcagaagcacgagggagaggctcatggccaggacaccccctgtggccccggccccagcccctccctccctggtacctctcagcaggtgagtggcactgcgcgtgcacaggatggtgatgaatttcatctcatcagtcccacgaatcttctcgcctgccgcatacagatcctagcattgggacacccacaataagccagtgagggagaccagggaggtgagggactgagccccagagtcccagagctgtggccatggcctggccctgtccactctgccaggccagcatgctcccctgcttggtcgtctctgacagggagctcccctttctctagcagctctggcttagaatattttctctatcctgggccacaagctgctctaggaactgcctggtccccagacttccctctgccagcaggcagacctacagagacccggacacctgtgtccagcactggggcctagcgcccccgggttcatgggctgttcctgccaggacagagctttagtgctcccccacccccaagtcacactccttcctcccgagtctcccaacaccctcactctcctccccagacaccacaggacaaaggcctatagggagctgagctgggtgggtcccagcccagtgtcagagaaagcccccgtgggcagaggagccggagtccagatggcagggggtggggccacatggccggctgggcgcagcctcacctgtgcgtcttggagggccagtcctgggtccacaaagctgctcacatcatccctgctgccctaggaacagaggaggtggctctgtaaggcaggccagctgaccagagcattaagggcacaggggggatcctgggcttggagggcaggcatggctctgctgctctttggctgtggaaacttcgacaagccagttattctcttcagcccttggtttcctcatttgtacaatgggggtggtaaggactgcctcataaggcttggcggattcagtgagctaaggtaagcaaagtgcctggcatgaggcctgcacgaaggacctgctctcctcccgcttccaggatgctctcacatggctgagtaaggacaggtgtgggggctctgcagttgggaccctctaaccatgctgagacacacccaatgagccctggctgctgggctatcccatgcccctaccctgactcttgtggcgctattcaagggctgctccctggggtggagctgttgggactcccaaaccaaggcactcccaagagcctaggctgtgacacctgcaggaggcacaccaggatcctctccaggtagccacttgtgtctgcttggatgtcctcctccaggctggacccatagtctgcagggaaacaggaccatgaggcacaagcagaggcccacagcctacccggggcctgctttcctccttccagccctgttccccatacttctccttattaaagccttctaggaaagaaagtccttggcacagggcatggatgcaatgcccgggtgtccaagtggctgtcgcctgggtggtgcttcacaactagaagcgacatgcgtacccaaccaagctcaaagcacaagatggaccaggtcagagagccaggctaggggctgccaaccaagctccatttcatctcaaggcttggcaaagccaaagcctccaggaaaactccccactaggtacatgatgtggaggactgactggcctctgctagcctggggtccacaccccctactaccacagtcctcaagggcagagattttagttggtcacaggcctctctcccctgtaagaggagctggtgagcttacagatcaagtctgaatcatgttcagtgtcaccatcaggcacagatcttggcatacggtaggtgctcagcacctgtgggtaaaaaagtccccaaagggtcctttctagtgtggcccaggttaattcttgatccttgttccctgccaggctgccaaagcttgtggccactcctgagcccctccatctgtgccaccccttaccttcctcatacgccttcattatctcccgcagctggttcttggtccgagaggccaggatctcaatgatgacaccctccttggttcctaagccctgtggacagaaacctctgcctgctggagtgctctgccatgaccttctgctctgtccacaccttcttttctcaagatgcctgagcctcaggaaggacctcactgccctgccccacttgaagtgggaggatgtgatgagaaaatcacatgcttcagtgatgaacattgagggcaagtgctgtgacggggaagccctgtctcagctctccctccttagctgggtggtctcagacaggctgctccatgtcctggagcctaagcatcccgatccataaacaggaataagaagcctcccctgcgccaaagatagattagggagcgtgggtgtaaaatgcctggcagtgcccatgcagcaagtgtctttccaaacaaaatgactatagttactgggtccccatccttattaatctgcaaaagcaaagagtagtgagaggtaaagggaaacccaaggggctgtgcctgggactgtagaggtgggtttccaataccactgtacacctgagctcgtgaggttctgagaagtactgattttggcttcatcacggccactcaacgtgtcaatcaggcaccagtgactccaggtgttgggtgcagtctgagcagcaggctgcctgctcactgggcccagttatggcccatatggccattccaaacagtggctcaaggggagctctgggctgtaggttcccggtccccgcattgcccctacccagtcatgtgagcacccctgccactcccctgccctgtctgcctggttaccttcatggcgtcatgcagctccttggcttcgtatctgtatggcgggtacataagggccacaatgagcctctcaaacttgccactgagctcagacttcaaggtctcagtgaggtcctaatgcgggaacagggaaaggtgatatttgtcataagccaggcccacctgagtgcaggcagcggagtggtggctgggtccaggggcttgggctggattctgcgtgggccttgccacgtgctggctgggtttcttgggccagctccttagcttctcttagcatcagtatctttaccggttacacggagagaaacgtgctcctgcttcatcccgttgcttagggggttgtgtgtgactcaattcagcattcagtgcagtgctgggcacatcataagctctcagtaaaatgaaattggtattgctagctagactgcaagctctgagtatggcatcaccataaaatacctgtcacttggcactcaatgaatgaatgcatgcctgaattaaagacttcgtctcacatgtgcctccttctaaggtcacatgttgctacgaggagccaccaggctacatcagctgatctacagagcagcagagagatcaagggctttgtcagacctggattttaatccccaccttgttgattacaggctctgggaccttgggcaacttaaaacctctctgagtgccagtttccccaaatgtttgaatacaaagaatgtatcactgtgaggactaagagagggaaactgtaaaaatgcatactgggttctccaagagaatatttgagctgatcttccttcgttacatctccaaactaatgatatgagtcactagaggcttgaggcaaccatggctgtgcacatatttaatcctgtgtttactgtgtacccccaaatgtcaggctttgtcctaggggtggagtgcaggtgggaggagaaacaaagggcctggcatgcttactccaggctcttagaattcccaggtggcagaagggacgaggtgtgggtgcaagcagctcgactgaggaaagcatgcccacgccccagaacagagcaaagccaggcctgcatgcctggggcatggaaaagagaaggtggtctgggctcagagggcagggcgagatagcctgggggcagggagacagacctccagtggggcctgttgggtgcatgagaaggaatgctgtgagagaggaggcaggaaaggaagcaaggaaggccagcccccggcccgggctctgacacctaaaagtagatctgccagataaaacacagggcagccagttacatttgaatttcaataaagaacaattgttttcatgcaaacaggttccatgtgcccatgctgccagtgggctggctctaggggaaagtcgtccagaatggagctgcctcccaggctgtacccccaaccccaaggctcacctatccccacccccaccagccttccccttgccttgccgaactgagccttgaaggacttggcgatctgctgccgctgcgtgttgcttctcttggtgagcacatcgatgatagcctgctcgttggtccctgcagggttacagcacaagtgaccctgctgcccccagggtgacacactggtgagggcggaggaggggaaggcgaaggcagctgcttggtggctgagcagttgggacccgacacctggatagttccaaacccccagaccattttcgtggtgtaaacaagacccttaggaaatctgcctccccatttcccaccccacacccccacaatgttggggcgtgcccaaggccagcctcacaagatggaatctgaggtctgggtggctctggacatcagcccgggcctttggagcttggccgagtgagatctctggccctgccctcctttgtgttggtcgcagtaggggaaggtcaagactaagagtccaacccctgaatccgaggcctggcccagcaactgcgtggcattgggcagccagcctcatttccctgggcctccgttttctcatttgggaagtggagataactttctgcttcacagaaagcagagggcatgagaacgttttctgggcttgtcaggagcggcagttctcattaaggcccctgatcctcaggcagagccggctaaggggtcagtcccacctggggtgaggtcagggtacatgctctgctctcaggtcaggagggctttctgggcaagctgtttaaatctggcctcaggccagccctcgcccactcacggtagtgctgagggcagcactgggcaagtgcaggagatgggaagggagccggctccatggccatcgacatggggcaagggggccttgaatcagccccacaaactcccaacacctcacacccctggcagctctgtgcctggcatcataaagcaccacccccttcacacttcatgtgacacacaaggccaagaattcttggggccactttacaagtgagaaagctgagactgatgggaagtcactcacagagacacacagctcacctccccacccccattacccagggaagagcagcaccctcctgtccagtcttgcagggtgggtgctgacctcactgcagaaacagagggctgtgtgattctctgggtagtggaatcagtttcagagtatcatgggacaccccagctccccagatgtcccctggcacccgctttccagggctgtgagcggaggggtcttgagcagaggtggcaaggctgccaacacccactcaccgatccccttcatggcttggtagagggtctctgcatcagggtctgggttgaagtgggagctgctcttcactgtgacaccctcctgttcaatctgcaagagaaccaggcctgctcaaagcaggcagggacagggagggcagagcaggctcccagcccatctggtagcccgccctgacagggtgagccccttccctgggcacggagatctgctcagcccttgcaggccagtgctctgcccttcagccccttggccaacagggtggagtagccagagccagagcttgtggggagaagccacaaaacctttcctgtccctgtctgtgccatctgactgcagacagcagccccagccacacccagctccttccagcatcacccaccagcagcaggaagggacaaactcacccaaagttaggaggggaaagaacactgaagcaaaggcttcctggagctgcatgcaccaccttcagagtgtgcagatgaggttggaaggctgagcatggttctgcctttctgaggaatggtttgagctcagtctgccctcttcctggggagttgggacttacagcaacttagagggcaggggcccagctgagcatattgatagttcagggtgtttgcaagtccacaggcccatggggctcagagcgtcaggtttagaaaaacccgcacgatgctctgcagattgtgaaataaaccagataaccaagtgcctgagcccttgatttccaagcctccagttcagggcttgcctgaaggctctttaaacttgtgccctgcagaatttctcagatgattaacatggacataagtgtgttttgggtggaggaatggtagagaatggagggatattggagataggtattgaattagagggagactcagagatcctccaggatgaaaaagagtttagtcccatccagtcttgtcttccatttacctgttcacttattccttccatcacctccatcatctgcccatctactttcccacctacgcacttacccatttgactaccacatccatccatccatccacccacccatccatctatgcacccgcccatccatccatccatccatccatccatccatccatccatccatcgaagccctgggttagattgtgaaaatacagagattccaatggatggtatatctgtaagtatctttcctttgagtaagaggtaaggcatctttctgaactctttgctttaatttcaaatgtctggtgacagatcttcctgagtcatttcttagcaccatgtttcacagcagaaattgttagaaataattcctatggaaattccatccagagagagccagtgtggtcccagatattgctcatcggtgtccacacacacgatatcccttgcttgtggagtcacgctctgctattactcctgttagcacttcaagccccttgtgtgtgccagacctgggccaggtgctttagaagcaatgcttatgtcatggcttcctcaacagttgtgctaggtaagtactgatgcctcactttacagaaagggagctggactcccttacacagctagtaagtgatgctgttgggactccccagcctgactcagaagctgagctctatctacctcccctgccctactgatgactccacctttcccagacaatgagtgttcctggaacgttccactgaaggaagcttcacccacaggaacgcaggtcatctgggaatgtgggaggcatctcagctctcagtgcctgccggcttccctctgccccagcactcgggggctgtggtgcaccagcgagtggccaggctgtgtaaccgcatccctgaggagcatgcagtcccgcaggggtgcggtaggtctcaggtgcagcatttgtaagcagctccctggctggttctgattttgctgcattgagaagcctctgtctcacttcccactctaaggttttagaaaataagtgttctgggaatcggagccctggctatcagtgtggagtcctggagctccagacctcctgctgagaaggaagggtcagcctcaggctcctgcagggtcttgcccagggccgtgctagtccagacaggcacattttcactgaaaaggtgactcagaccagcctgtgactacatctattaatataacttgttctgtgacaggcacaggggagctgccacgccttggccttcccctgctacgtggctgcccagaggcctgggagatgggtttgtctctatgagagacacagaggaaaaggcaacaccaaaaagagaggtgcagatggaccctgcctgcagacagatctctctccagtggctccctcatctcctcccatcgcgttcctggcccagctttgtgcctagaggacactgggtcttcgctagcagctcagctgttgcaggtggggtctacctgtgaacttgctacccctagccagctctcacatggggtatggacgaccagggtatggttttggccctggagtcaggctgttcagattctcacctagactctcacacttactagtgagttcgggcacctgcctagcctacttgtgcctcagtttcctcatctgtggataaggatactggtgtctacttcatagactccttgtgaggttcaagggagatattgaatgtgaggtgcttagagaagggtccggccacagagtagggactcagtgagtgtcacagtgatcctgtcaatttggcaggtccctacatggacagccctttgtcctgctgcactgggtgcaaggcccagtgccagactgccttggccagcaactgactttggaaaccacccagcactgggctctccctgccatgtccacctcctcaaaggcaggttcccagcagtctggttgaagctgcaggcctccatggccccttgtcctggaagaaggctgcttccctgggggccaggacagctgccccacctcagcctggcttcctctttgtcccacctgtccagaacctagcatgtctgaccctgaggacacttgcttgggttgcgacatctatgatccagagactccctgaagctggacaagcctgggtatcccacaaaagctcacagagaacctggggctgggcagagagacccaactgctctctgactggagcctgctggccattggaccctagcaagtcactcagtgtctctgagccttcatttcatcatctgcaaaacagaaagtgcagccctgacatcctgaggctgcctgggaggaaaggaaaagggtgtgcagagccggcagccgggagatgtcacctctgtccccttctggatattcaactccttagcacagcgatggcctcaggctcaaccatagatggaaagctcccgagaacccatcagttctgctggggatgggctgccctgagccccgggttcctccaggctctagcaggccaggtcctcctgcttcccctcttccctctccagtcttgacaaatgaacatcattgatccctgaggtgaaggcattgatgggtccccaacagcaggttcaggttactctcatgctcaaagcccttcagtgccttcccacttctcttaaggtaaagcctaactcctcagcctgccaggcaaggcctttcaggacctggccctgcctgcttccccaggtccatctcctccggtaccaggacccttgagctgtgctgagcagcttccctcgaagccaagctccctgccctctgaccctctgcacacagttccctctgccaggagcagtatgcctgattctccccaaatgcacacgtgtgtgcaccccatacacatttacacacaaggctcaaccatgataccccctcctttgagtggccccacccctgcaagggtccctcccctggactcttctcaaacctcagcttcccccttgcatttctagatttcttcatcagcctgtctcccggcccaggtcccatccctgccgtgggcactctaggcctgggactgtttcttctcggccccttcccaccctccatgcttggcccaggaggcagccaaatgtagactgagccactcccagccaagggcgactttacatttctcaggactccctggtgaccagcacccaacaccatgcaggaacccaaatctcctgccagctcccacttacccaggatttccaccaggccatctctttcacctcgggggcacctttcccagggagatgaagagacacaggttggcctctgctgggactccacacgtctggctcctgcagctgaggagtgagcaggccgctcacttgggtgtgggggtgcaagcccgcccagggcagcgccacacctgcctgccgtcccctcgcccccgggctctgcctggctttgggcatctcctgtggctcccaggccccacccagacactgcccaggcctgctctggggaattacacaactcactggcagatatttgggctgtggctgttacgcatactggaaattcttagctccagcctgcgaaagccccactcagtaaacacagctccatgttgattaggctggtctcaaactcccgacctcaggtgatctgcccaccttggcctaccaaagtgctgggattacaggcatgagccaccgcacccagcccattttcatcactcctaatagccatggagtatgccatttaatcaactgcatatgcaatattattttttttttccgggggcaaggggctcatattcaccacagatgggaggccagttggtgagaaggtggcaggcggcacagccaccttatacagcatgccatactggtccactgtcagaccggtgatggcctcagctccatcaccccccaggctgactctggctcctgcctggctctgcccggccaccacaacccctcgggaccattcagaggcatcactggaggatgtgtggttagtggagcagctggtcatggggaggtctcgtttctttggtggaaggcattcctggttcctctcatgaacaggtttcatattgctttgtggtgttcctggagcctggaaggagttggcttgctccctggggcatcaggaggggcttctctgtagcttctctgaacccctctctgcttctggctggggcacctacatctgagcttccagtggtgcttctgagcagctgtagtaagcgtcctcccggctggctcgggagccagcccatttcaccacgcttcccgggatccacccgctcatcctggagccgctgcaaacctggccgccgccatccccagccccggagctgccccatacccctgtatatgcaatatttgttaaccattcccttttggtgcccatctaggtacaggtatcatttttggagctaaagtatctataatacactggaagtaacagatgtcacctccatattgtacgccaaacctaataagcagagcaaaacttttcatccaagcgatttggttaacattttaggatgtttctaatctctcagtaatacaaatatgctacaatagatctgtgtgtttatcctttgggcacctgtgtgtgcctgtgcatacctggagaataaagtcctgtgagaggaactgccatccaaagagggtgtttcagtctgtactgccaccaacaatgtgcttgtgcttctgagcttgcgtttgggtcaggagaatttgaaagtcatcaggaaccaaaccaggatataaggttcagctgtagctggaaagtggcaagcgttccaaagctaagacattggctatacctgggctgttcacaaactgtgagtccaattctagatgagatccagaagtatggtgagcaactcacttattttttaagcaaaacaccttttcttctcatttctgctaagaacaaatagcttccagcaagagaaataggggatgcaatatttttacaaattacttctcttttttttaattaaaaaatgttaagttaaatgctacttaaagatatgtttaacctctatgatactgacttgctcatgagaaggagagagggccaggcatcttgcccactactacccactatcaacacttaggcctgacatcagtctctaaataaatattctgggccaggtgcggtggctcacgcctgtaatcccagcactttgggaggccaagacaggtggatcatgaggtcaggagatcgagaccatcctggctaacatggtgaaaccccgtctctactaaaaatacaaaaaattagccaggagtggtggcgggcacctgtagtcccagctactggggaggctgaggcaggagaattgtttgaacccaggaggcagaggttacagtgagccaagaacatgccactgcactcctgcctgggcaacagagtgaaactccgtctttaaaaaaaaaaaaaatcaacagcagcttctaggatgatgagcagtgactcagtctctccttgaccagattctgtaaccgtccagcagaaatgcttatctgatctctgcgagaacaggaagcagctcagtgggggccttccttgctaaattcttcatcaagctggtctgttatctgccctgagtcctgcaagaacatctcaagaaaaatcccaaaaacatgcaagacaaatgagggtcctcccttagcatgtcttgaagcactgaggcacctgaaagttgtatatagtttctggtgaaacagttttttaggaaatgaagcacagacactaactattcttccagaagagccccttcctgacatgaaagatcttacttagcatgacagagaagcatctgtttcatcatgaggacctatccaaccagcagcaggggccccagtgccagtgtccacctcagcagaggagacacgggggacatgcaaagtgtttctgttgaaaaatacttcacctagggtgactatagttagcagcaatgtattgtatatttcaaagtagctagaaggctaggtacagtatcccatgcctataatcccagcattttgggaggcccaggcaggcagatcacctgaggtcaggagtttgagaccagcctggctaacatggtgaaaccccatctctactaaaaataaaaacaataaaaaataataataataaaaattagccagagatggtggcctgcgcttgtagtccaagctacttgggaggctgaggcaggagaattgcttgaacctgggaggcagaggttgcagtgagccgagatcacaccattgccctccagcctgggcgacagagcaagactctatctcaaaacaaaaacaaaaacaaaaacaaaaaaacaaagtagctagaagaagggacttgaaatgtacccaacacatagtaataccaaatattcaaggtgatagacaccccaaacaccctgattgatcactattctgtgcatgtaataaatacttaagtgtacaccataaatatgtaaaatatgttatgtcaacaagaaaatactttgcctagtgtttccatccaaatgggaataaatccagcgctcaatgtacacatgtcatggctttttattgagactggggaagggccgtggtagcaggtgcactcactgtccaagtttgtccagactttctgctgcatgggtgatggcatttgtgactgtgttggtcactgtctcggtgatttccttcatctttttgtcccctgactcctgggctttctttatggcttcagcaatggctgttggaaagaggaagaatgtcctagtgatccacctgctgaacttgtgtccccttgagtggcctgtgggatgtggccatcttaatggattagtctctggagtggcccgatgggaccaagggcagcaggattactgcagaatgaatttgaatttggttttaatttccccaacaacttgcatttcttcaactgtgagtgagactgagcatctactcatgggtacattgcctgcttatccttttttctggaaaatgcctgcttatgtcttttgaccatttttatattgggttgttatattggattatcatttttatgacaaatatttttcatcagtgtataatttttcttttggcttggtttatagtgtttttttttttggctatagaaaatttcagttttggattgtcaaatttacttaatatttcctttatggcgctgatttttttgtcatagttctaaagattctcccctctccaagattaggccaaagtctctgatgttattactatgtctaaatgtttacgatgtcttccccctcaaaactcatatgctgaaatcctcagtcttaatgtaatgatattaaggggtggggcctttgggaggttgaaattagcacccacataaaagagaccacggagagctagctccttccaccatgtgaggacagagctgggcccatccatgaaccagaaagactccctcaccagatgccaaatgtgccagtgccttccttgatcttggacttcccatcctccaggagtgtgagaaataaatttctgttgtttctaagtcacccagtttatggtttgtttttgtttttgagacagagtcttgctctgtcacccaggctggagtgcagtggtgcaatctcagctcactgcaacctccgcctcccaggttcaagggagtctcctgcctcagactcctgagtagctgggattacaggcatgtgccaccatgcccagctggtctttgtatttttagtagcaatggggttttaccatattggtcaggctggtctcgaactcctgacctcaggtggcccacccgccttggcttcccgaagggctaggattacaggcgtgagccactgcacctggcctatggtattttataagagcagcctgagctaagatgtttatctcctagtaagttaataaattcatttatgtaaatgtaagtccttcatctacctggaatctattttgttgaaaaggaatgagatatacacatgctttgtacatagtactactcatagctcacacacatcaatttaacatttaacatagaattttacatgttaaatttttttttttttttttttttttttttttttttttgagacagagtatcacactgtcgcccaggctggagtgcagtgtcgcgatctcggctcactgcaagctccaccttccaggttcacgccattctcctgcctcagcctcccgagtagctaggactacaggtgcccgccaccgtgcccagctaattttttgtatttttagtagagatgcggtttcaccgtggtctggatctcctgacctcatgatccgcccacctcagcctcccaaagtgctgggattacaggcgtgagccaccgcccccagcaattatttttttctttttttttgagaccgagtcttgctctgtagcccaggctggagtgcagtggcatgatctaggctcactgcaagctctgcctcccaggtacacaccattctcctgcctcagcctcccaagtagctgggactataggcacccaccaccatgcccggctaatttttatgtatttttagtagagacggggtttcaccgtgttagccaggatggtctcgatctcctgacctcatgatccgccctcctcagcctcccaaagtgctgggattacaggcatgagccaccgcaccctgccatgttaaatgttttgtcccagtgtgctgtcacatagtcttgtgtgactttgtcttcttattccacagagagaaccatctagacagtgtcctaacgcagtacagtctgtggcctctgatgagcatagataactgccccagccaagaggctctgaaaggctgcaacattaggggcagagtttgacctggttagtcaaagaacaggttggcccagcacctagcttcccttcctccctccctccttccctgcccgacctcagccggctgtacctttctctccagtctccttggcatgtcccaccacctccttcaccacttcctccacggcatgaactgaacagaggagacaagtccagggtgagggctcagagcaggccggctgcccccgagtccagggtgagggttcagagcagagccgctgccctcccagtccagggtgagggctcagagcaggcccactgccctcccagtccagggtgagggctcagggctggcttatcctcacaacagacctatacatccctgggcatcctagatggggctctggggtgccacccccagccaggacagactgactcatgagaaggaccttcccccacagctggcttcatttggagacgccagggccttggctgctgggagacgagctcaatgagccccatgagggcatgggtccctgaagccccttggccctgcccggcctggaatggcaatgagcaggcagtcttgccagctgagacatgaagcccaggctgggcctgtgtgccaggtcacacccctctcaggatgtgctagcgcctgcctcaggttggtttccaaagcctcatccactaagaccaggtctctcaaagcaattcctccaacaaaacggaattctctgcctacttcagagttttttaaagtgtgggtggtagcgtgctagaactgaaggatttcagagtcagaagaaatggttcttattctaactctaccttccacctcttggttccctcatctttagaatgggaatctgttgggatgatgagacccaacaccaggtcacgggggcggcaagtccagcggagtcaaaggaatgacaaagagacagttcgagagagaaaatgggagcagggcgctatcgcgagtgtggaggctgcgaaggccccgagttctgggagcccacgctatttattggtgatctaacaaagaaacaggtggtgaggatgtggaggttgaaaggaaacagtgtatcaagtgaatgagaaacatatggctacttgagagaatggcagtgctagaagcaaggagccagcaagtctagcaagccctgcctcagcttttctcccaacgctgagcttttctcccaacaggaatcataaaaaactcagaggctagtgaaaggttaaagcaggtggtccacaccagctgcagagtcaaaaacaaaatacgcatctgctgccatttagaaagaggacacaaactcaggcaagactttttcacacgatgacccatgagtggggcctggctgggcctccccacacatacctgctgacctctgaatacaacatacacttcgggaccaggtgcagtggttcacgcctgtaatcccagcactttgggaggccaagaggaatggatcacttgaggtcaggagtttgagaccagcctggccaaaatggcgaaaccccgtctctgctaaaaatacaaaaattagtcgggcgtggtggtgggtgcctgtaatcccagctactcaggaggctgaggcatgagaatcactttgaacccaggaggcaaaggttacagtgagccgagatcgcaccactacactccagcctgggtgccagagcaagactccatttcaaatacaaatacaaataaaaataaacatgctttaggggacttggatgaaattgaaaatgcccttttagactttgaacagacttggtgacttgttaagaaatctttgaagctttaaagttatggtaaaaataaaaatccatcttccttttcctgcataggttattcagaataggctgttttgacaagaaaggctccccagatttccagagggaagggtccaagctgccagtgttcacccagcaccaggactcatgccctgcccccaggagacctccccaggtctgcacccctcaactccgtgctgacttggtagagcaggagaccagggttcctgaggggccaaggcctccccgcaggtcctcgcctgcctacgtagatccgcctcccacagacccagtctgccccagatccccccagcccaggtagaaaggagccctgggtcctcactggctccctcggtggccttctcggtgcggtgggccaggccctcggcagccagcttccccaggcctcccagcatcgtgtggcagcagacagtggcgaactaggatgctgaggactggcccaacatgcttttatagctgcctctggtgcctatctaggctctggggcaataagccctcaccccagcccagtaggaggctggacaggtgagtcagtgagggcggcagcaggaaggggctgggcggagccaccctggaactagggtggcagcatcccctgacagcatgaggcttctgtaaccctgtcctagggaccccgtgaaggataggggcatggagcagggctggacagtagagatctggacatgcttcttccttgaggcagagggcctgagtgccagcccccctgagaccaaagcttcccaagcctgggtactgatatgtacctggagacaaggcctaggattccaagcctgctgctcaaggtccccagtgtggcctagtaagaggtttgggggttctatgggcctggagacctgggcagtcctttgagtcatgaacacaagtggaatgagggtgactgccctccccattcctggagaccctggctctgcagagcagtttgcggcctccatgggacagggtggggcgttcagggtggtgccttgcccgagtcagaggggggcacagcactgggcagaagcgtagtcacctggtgtcgctcagctgatgctcactcacccaagaggctctgtgaggtcagcagtgccctcctatcccctggcagtcctggaggagtagacagaggcctccaccaccactcagggagatgcttctggccttagctagaatcccctaggaagcagcttccctggctcctggtgcatcgcatgaggagtggcagggctgctccctagttactcatgatggacagacatgcctcaagccacctgccacatgctgcttcccttagtcaccagcccaacctgagcctccgtttcctcatctgtaaaatgggcatagcgtgccttcttggctgtgtccctaatcatccctgaggcaaagcatgcaagctcctggtaaacacctgttccctccactcatcattgaggtgccctttggcagtgagctctgaccaactggtagggtgtgccaaggagtgactgggacgtgaggctgccttggagccagagggctggggaatgtgacttctgctggccaggagccaaggagaggtcttcccatgctcctacttctggggtgcaggcctgtggcaggggtctgaggctctctccccaatgcaggctcctggagctgctctcctggatgtgtcggggcctgattagtttactggactgtgggccctcccagcctgggactcgggagctgagaccctcttgcattcctgcatggtgtttgcgggctccagggctacggccagtccccctagggtggacagtgggtatcgtgggcagcaggacctctgggtctcaagactgtggccccacacatgccattgctgtctcctttgggcaggggtgaatcggggcttcaacaatttagaggggcctctttatgaaaaagaatacaataatatgattcttgcacatttttcatttatatacgtatgaacttctggacccagaaggggctgtgaaagtcgggggcctggagctcaggcgggtccagatgaccctgtcctccttttgtaacagccagagtccaggatgctttgcccagggcattgggctggcactgcagaggcctgggggatggggtgacacctgggacatggctggtgggaattgttctaggaaacctcagggattctccctggacctgtcaaagccccttccctgtttcttctgaggctgtgtgtccccccactcacacaagggtcctttctatgcctgctcccctgataaatgtcatctgcctgctctagaatggcttccagaccccacagaccccctcctcatgagctcccaccctagggtactctccaccagtccccgctttcaggagctcaccagacccagacagcctgttgtcagagctcatccacacagcaggaccctggcccactgcccagcccagagccaggcccaccatggcctctggggacaactgcccttccccccaccccctccacatggtcccctgcccatgagaccctgccctgctaatttaatgcactgccttggtgtgagcactgtgattctaatgacaacacaccatggccttctgggcgaggctgggtccagacacagatcccaaatgcctgctggggagaaggcaagaggcccggggaggcccaggacaagacatgggtcccaggccctggtgccctccctcttggccttccagctgctgctgctgtgaccagattcccattcacccagccccgtccatgggccccagcaagccatctgtgccccacagagggcagacccctaagagtgggacccctttctagccaaagaacatgagatagccccaaatcctcctaaacatgatggatcctggtctgaggggctgggctcaggtgactcctgcagggaacttcacctgcctggatgaggtcaagtgtgaatcaggtggggcctgccctccaccaccccatcatggaagaggtccagcccacagtgggcccaagagggccgcccttggacctagggacccaagtcagcatatcctgagtcagaaggtcaagtccagcctcccctcaggcagggagaatctggctttgacaggagcagataaattctcaaggtggaatttgcccaacatactagtttggcaagggactagctggctgaatcactgagtcaaggacagccaacgtttccaatagcaatttgccaacttagcaattaccaattctgaaaaacaatttgtttatttgaaacacttaaatacttaggctgtctcatgtctgaagcatgatgatgccttgcgtgatttaaaggacagacgtcacgaatgccaagagttttgtggcggtccatcctgccagtgtcttctcccacttttgttctgtggatttgagctcacagtttgtgctgtgcccaccgcctgcccaccctaacgagactcctggagacttggctggccagtcaccagaggaagaggggcccagcagcacgccagcattcacccacctgtgggtatcagtcaggctcctggtggaagccagaggacatattcgaatgggtacttgaggaaaggggctgttcacagaagtgtggaccgagttaagggaaccaataagagatgaggaatgtcctggaccagcaagagtgggagctgttatctccctgggtctagagggacaggaaaggtgtccacagatcccaaagagagctgtggctgtagaggaggatcatcaggagctgcagccatcagtagaaagatgtggccactgccaaaccaacaaggaagaatctgagcgaataaccacctctcctctctctctctctcccacctcctatgacgtcctccactgtgtgaattccactagggccagacagtgaggcaccctggtgatgcagtccaagagggagtgggcagagaggagccagtgggtatggaggggaaacagagaaacagagaattccagctcactctgcgggatttctgggtctgatagaaacatggcattattattattattattattattattattattattattattattattttgagatggagttttgctcttgttacccaggctgaagtgcagtagcatgatctcggctcactgcaacttctgcctcccgcgttcaagagatcctcctgcctcagcctcccgagtagctgggattaccggcacatgccaccatgccttgctaatttttgtatttttggtacagatgaggtttcaccatgttgaacaggctggtcttgaactcctgacctcaggtgatccacctgcctcggcctcccaaagggctgggattacaggcatgagccactgcccagcctgcagcagcttaattttacagtgtcccttttctccttctggaaactatatggggcaacaacaagactgaggaggaagaggaggaggaggaggaggaggaggaggaggaaaaagcccatcatcaatacacacatcaaactcaacttcagagaaattaggaagctgggaagccacgtaaacccaaaagcaggagacaccagcagaaccaacgcaggaagccagggaagtgcagaagaacagggcatggggggcaacccaggggggaatcttcactgttgccagcaacacacattcccagcaggagaggaccctcagagtgagaacgcagagctggagaaatgaagaaggagcaggtggtgcccggggaagtccaggggtgtgggatctgagagcacgccttcccaagagaggcgggaacacttgggaaggcagggctgagtccctggaggctgtatctgggaaaggaggctggcagtagaatcttcctgaagccgagtaggttctgagaggcagaggggcagtggtacagaggtgaggctgacgcttctgtgcaggaagggcaggctcctgaggaagggagccccgaatgctctccactagattcccagggagccccactccctccacagggacctcgcgctgacatctgggaaatgccattcatactggaacgtccgacacactgccatgaatgtgagggttttgtgactgatggggtaggtttctctcttccaacttaatagtataatgtccatttattcctcccccagcctccctgaacatgcacctcttagatagccacagtacggtgatcagaaccaggaaatccacattctcatatttaactatattaaaattatttcacaaaataaccaattttattaatttaattaaatacatttaactaatgtttaaatatatttaaataatttaactgatttaaaatgaacatattcgctaaacaaaagaccttattggagtttcaccactttttccactaatgtcctttttctgttcccaaattccacccaggatcacgctgcatttagttatttcttagtctctcgccgttttgtaggactgcaataacagttcctcaatctttccttatctttcataaccgtgacatcttgaaccagtactgatcagtatttatgaaatgttcctcgatttgggattgtctgatgtatttccatgattggactgaagttacgaacttttggcaattacagcacaaaaatgatgtggaatccttcccagtgcattccatcagagttatggcattgatagttcttcttactgatgatgttgaacttgttcatttggttcaggtttctgctgggtttctccattgtaaagatactatctttccccctcatagggggaaagatcttaggagaaatacttggagactatgaaaattttgtattttctcaaacgttaaaattttttttcaggccaggcgcagtggctcatgcctctaatcctagcactttgggatgccgatgtgggtggatcacctgaggtcaggagttcaaaaccagcttgatcaacatggagaaaccccatacctaccaaaaatacaaaattagccaggcatggtggtgcatgcctgtaatcccagctactcaggaggctgaggaaagagaattgcttgaacccgggaggagaggctgcagtgagctgagatcgtgccattgcactccagcctggataacaagagcaaaagtccatcacaaaaaaaaaaaaaaggccaggcgcaatggctcacacctgtaatcccagcactttgggaggccaaggtgggtggatcacctgaggtcaggagttggagaccagcctgaccaacatggagaaaccccatctctactaaaataaaatacaaaattaactgggcatggtggtgcatgcctgtaatcccagctactcaggaggctgaggcagtagaattgcttgaacacgggaggtggaggttgccgtgagccgagatcctgccattgcactccagcctggccaacaaaagcaaacctccatctcaaaaaaaaaaaacaacaacaaaacacctattttgacagccgggcatggtggctcacacctgtaatcccagaactttgggaggccaaggcaggcggatcacctgaagtcaggagttcaagaccagcctggcgaacatggtgaaaccccgtctctactaaacatacaaaaattagttgggcatggtggcatgtgcctgtaagttccagctacttgggaggctgaggcaggagaatcacttgaacccagaaggcagaggttgcagtgagccgagacggcgccattgcactccagcctgggcaatagagtgagggatctcaaaaaattataatgaaaaaataataattctattttgaattgtggtaaaatatacataaaatttactaccttaaccacttctaagtggcagttggaacaggggtcaaggagagcccttgggttgggtaatgtatattcacattgccatgcaaccaatctctggaactttttcatctgacaaaaccaaaactctatatccactaagcaacttcccattttctcccttccccatgtccctggcaacccccgttctaccttctgtttctattagtttgcttactcagtctggacgcttcacataagtgaaggaacaccgtatttgtctttttctaactggcttatttcacttagcgtaatgtcctcaatgttcatccatgttgtagcatgtgttagaatttccttcctttttaaggctgaagaacattttattgtatgtatataccacattttatcaattcatctgcctatggacaactaggctgcatccatcttttgacgagtgtgaataccactgctataaatatcagtgtacacatatttctatgagaccttgctttcaattattttggctatatacccagaagtgatattgccggatcatttggtaattctatttttaattttttgagaaactgcctgtcctgtgctgagcaggtctatataaacctacccgcaaaggccaaggaacctgagataccaaagaaagaggctgacaaatccagtttctcagaaagaaacatttaataggcgtttatgaacagaaggcaagtcagggatggcaccaagataagatggtggatccctgtgccatcacccccacccccccgacccagggcttctatagcataggggaagggtaatgcgggcttcagcagggatgtgtatggccagacacggtggctcacgcctgcaatcccagctctttgggaggccaaggtgggcggatcacctgaggtcaggagttccagaccagcctggccaacacggtaaaacctcgtctctactaaaaatacaaaaattagccaggcgtggtggcaggcgcctgtaatcccagttactcgggaagctgaggcaggagaatcgcttgagcccaggaggtgaagtttgcagtgagctgagattgtgccactgaagtccaacctgggagacagagtgagactcggtctcaaaaaataaaaaataaaaaataatttttttaaaaagataaaatagaaatcgtagatgaattgttggaactgggattaatcagaatatggcagattagcatccaagatggaattgctttattctcattcaaggtttccctcattcttcactctccccatgctggtcaccttgctgtttgttcctcaaacacatatgaaatgcgtttctgtcttggcagtcatcctgctacctgtaatgtcagcactgctttctgttgtcccttcagtcaggtcactgttcaaatagctctctagacaggctcttccttatcattctacttaaaatagcccccaatcactctgtgtccctttagcctgcttcctcttcctgctatttcatactacctgaaaaaatacttgaacttcctagaacataagctcataaaagcaagaactgtgctccacctctcctctcctctaccccagcactcagaagagaaacagagtcagcatccagtgagtgttcatgaatcaagtcactgcttggcagaattcagcactgggaccacagcctcgcctatcttcaactctttctccttctgcttttcctcctcccactctagtagccactcttctgggggcttgtcccttaaatgattagtccttactgacctattttctgtccactttatctgtttttgagagagggtctcactctgttgcccaggctggagtgcagtggcatgaatatgggtcactgcagcctccacctcctgggctcaagtgatcttcctgcctcagcctgccatgccatgtaactgaggccacaggcatgtgccaccatgtccagctaatttcttgatttttttttggtagaaatgggtctcactttattgcccagtctggtcttgaagtcctacactcgagcagtcctctcaacttggcctcccaaagtgctgggattacaggcatgagatactgcacctggtcttattttttcttttcttaagatacagggtctcaccatctggcccaggctgaactcaaactgctgagctcaagtaattcccccacctcagcctccgaagtagctaggactaaaggcatgaaaccaccatgcttggcttgtccaatttcattctacacactttcttggtatttaaacagctgctgttgctcttcattctgtagctctacatcagattcatgctctagtcctgtatatccaaatgatgactagaggctgccggctctgctctttcaaaggcacaatgagcgtagcccgtctacaaaactctcccttttccaatccagctttccctcctgcatcacctatctctctacatctggaaccatcggcagctgccttcataaggcacctcagtctggcattcggaaaaccaccctgtcttgccagagcctcttggtcttgggtagcaaaagctgtatgcaatctaaatcaagctttcaatcatgagaaatcacattccttcttttccctttgtaatatactcatgtgtttttttttttcctttctcaataagcaaattgtaccaccatcttattctgagatgctcctttttaaaagctgtagatcacattaatggaagtggttactgctgggaatattttccatgtgcaatgatctgtaaccctctttttcttttttttgagaccgagtcttgctctgttgcccaggccagagtgcagtggcacaatctctgctcactgcaagctttgcctcctgagttcatgccattatcctgcctcagcctcccaagtagctgggactacaggtgcccgccaccacgcccagctaatttttttttttgagatggagtctcgcttggtcgcccaggctggagtgcagtggtgcaatctcagctcattgcaagctccgcctcctgggttcacgccattctcctgcctcagcctcccgagtagctgggactacaggtgcccgccaccacacctggctaatttttttttttttttgtatttttagcagagatggggtttcaccatgttagccaggatggtcttgatctcctgacctcatgatccgcctgcctcggcctcccaaagtgctgggattacaggtgtgagccaccacgcctggccattcccagctaattttttgtattttttagtagagatggggtttcatgatgttagccaggatggtctcaatctcctgacctggtgatcagtccgcctaggcctcccaaagtgctaggattacaggtgtgagccactgcgcccagcctaactgtaaccctcttatctcaactagctgacattattacttcacatccagttcaatttataaattaagagaggtgccatgggcctggtacggtggctcacccccataatcccaacactttgggaggccgaggcaggtggatcacgaggtcaggagttcgagaccatcctggctaacatggtgaaaccacgtctctactaaaaatacaaaaaattagccaggtgtggtggcaggcacctgtagtcccagctacctgagaggctgaggcaggagaatggtgtgaatccaggaggcagagcttgcagtgagcagatatcatgccactgcactccagctggggcaacagagcaaaacatcgtccaaaaaaataaaaataaaaataaaaatgaaaaagaggtgccatgtgtacaaaaatcaatgcacatttatgaaattttttttcaaatatattttcacacattttatctaaatacataatacagaagcctgtgtgacttgggcaatgtggccaggagggcctgagactaacacatccaccttggcaaaaggacataaaatatgtcttatggtcagaaaaatcaacattttgtgtatttacttagtttacgaaaagtactgaaaatgctattactagctgaatttgtgatttccttttgaaattctgagttatccttatttttcccattttgtttttgcaccaaggagactgcagtcaaataaaacagatactacacgcactcgtcggggcagccgtactgcagaagcacgttgatgcactcctggctggaggcctgccgggcgtaggtcagcgctgtgttcccgtgggcatctcgggccatgacgtccaccccgtcaggagctgctccaggaccacattccccttgcggcaggccagatggagtgccgtgcagccgtctccctccccacaggtctcgttcacctcctcacgggagccatgtgccagcagcaggatggctgtctgcaggtcctcatcagtggtggcccgcagcagctgctggcccagggacagctcagtgcagggtagtggggccagaaagagcttctcctcatatttggaacggatccaccattccttctcttccctcgtggactttattgagggttttgtctgcccctggctgctcccttcccagatgctgttggctagctcattgccaatagatgacataaccttcctgagctcaactggccagtcatccagctccagagatcgcacacgggaaaggcgggtgccaaaactgcggtggatacctgagcattcaatacacatgaggactcccaagttcaaactggcccacttaggattctgggtctcacagtccacacagtgggcgttcccacgcatgttttggatcgactgcagggccatggcctcactctggctggtcagctgggacttgcttttactgctcttgcatgactgcaggctggccaggatctggctctggatggcttggacccaggcatcccgctcctcatacgtcgtggcttcaaagtgccacgtttggccagtggcagacacaatcataaagttgttggtgcttttcttctttaggtgtttctttttattggcatgaggagaggggggcgggttgagcttggggctggtggtgctggagataccggggctgaagcatatggagtcacccagcccggtgtccatgtccttggataggccattgcttttagagctggagatgggtgcacaggctgatgtggctagggatggccactttcctgggactttgatggtagatgtccgaaggtcaatctcttttttatgaatattcttcatataatcacctaagcttgaataataggtgagcacgccattggaacacagggtgacgtatttctttttccatgtcttcagccattttccacttcgctttaagagcatgccctgtttaatggggatggctctgccgctcccgatggtgtcagcatgattctccggggctttcctctctttgtctgggtcactccctttctcagatgtaaacaggttggaccagcgcatggacagcttgcaaacgggggtgggtgtgttggcagtgggaggaacactgaactgagggtcctcctggctggtgctgggagtcggtggaatggaggaggaatagttatttaaactcccacctccatttcttttcttcataatgtgcacggtggaaacctgtgtggaacaggaggaggaatggcttcaaaaattgggtagtggcttgcaggatcctatagacagctcacaattaccttttaaaaagatacattttctgggccaggcatggtggctcacacctgtaatcacagcactttgggaggccaaggtgggtggatcacgaggtcaggagttcaagaccatcctggccaacatggtgaaaccctgtctttacaaaaaaaaaaaaaagaaaaaaaaattagctgggcatggtggcacatgcctgtaattccagttactcgggaggctgaggcaggagaattgcttgaacagggacctgggaggcagagcctgcagtgagccaagatcgcgcgattgcactccagcctgggctacagaaagagagtccatcaaaaaaaaaaaaaaaaaaaaaaaaaaaaagatacattttctgttgtttggatagtatatttactcacactagctcactaactaaacagagctgcagatcagttcttactccagcacattctttttacaacacttaagatgactaaatgcaacatgaaatggggaagatttaaaaaaagatggctttgacttcagcatgaaacagatacaagtgtacgatgaaaatacaacctcaataaaagtgccacttaccgcaaatgagtgtaactgttcatcaggtatgctcaaagatctatctgcatctctataaaataagaaagtgcattacttcaaaaactgttaatatcttagtataatatttgttgagtaaaatacttcctcctgtgtgctttggtgtttactttaccaaagcagtttttacaaattcttctcctggatcctgacttgcagagggtttcctgacttcttctttctcagcacatcatggtctgtaccgtgaagccttttatatgataaccagtcagaaatgcccatgagtattgactctccctaacaggccatggcaataaaccaaacatattttcactcttctaaccacacattgaaacacaagaatgttctacaaagcagtagtagtaaactttaataaatgtaaatgtgattcagatttcctagcttcctttctctttagttctctgtagtatactctcatgatgtttttatgtattttctgttgtctgaatgacaaactcatctacctttttaagaggccagtctttgaggaactttaaactttgtaaaactaatgcattgtgcctgtgtataaaccagtggttctccaaatgtgctctgtggacctctcgggatcccgaagaccccttccagaaggcctaagaggtcataactgttctttttttttttttttttttttttttttgagaccaagttttactcttgttgcccaggctggagtgcaatggtgcgatctcggctcatggcaaccttcgcctcccaggttcaagtgattctcctaccccagcctcccaagtagcagggattacaggcacctgccaccactcctggctaagttttgtatttttagtagagatgtggtttcaccatgttggccaggctggtcttgaactcctaacctcaggcgatccacttgcctcggcctcccaaagtgctgggattacaggcctgagccactgtgcctggccaacactgttctgaatcatactaattaaacctgagaaagctgatgaaaaattttaaaaatttgtgaaagtaatacaaagtcattgcctgctttttcgttgacacttgccatgattgtataaaagcaaaagtaggtacaatggctggtttctcagcataaatcaaggcagtggtaccaattacattagtagtcattctattcttcactgtcccctacaggtaaaaaacatagcctgaatttcttaagaacgtctttgatgaagcaataaaaattaatgttgttaaatcttgacatgtctctaatattctgaataagtggaaagttaatgagaagtgctttttttttgtttttaaagaatccgtgatttaactgtgaactgaaaaatcacttttttcacagaacatcatttttatttaaaagtacaactgggccagcgcagtggctcacgcctgtaaaatcccagcactttgagaggccaaagcaggcagatggcctgagctccttcaggagttcgggaccagcctaggcaacataacgaaaccgtgtctctatcaaacatataagaaaattagcctggcgtggtgccacacatctgtggtcccagctacacaggagcctgaggtgagaggattgcttgagctgagatcatgccaatgcactccagccaagtgacagagtgaaactcggtctaaaaaaccagttcaactatcattctcaaaaataaatgaagtgagaggttgtcacttcaagggaaatacgtatttgttcccaatgataaaatttaagctttcctgtggactttgaaaaacttgttccttctactgtaggcttggcagcttttcaatacttaaaggcctgttaaagtaagattggtggttaaactaaaagtgatttttgacacaataaaacataaaccaatatattccaagtaactaatgcatgatattataaatgcaagtatggagcaaaagatccatttactgtgcaagaaagatcaatgagtactgatggaataaatttattaatatgtaaaatgccaccgtaactaatttaagaaaccaccacttgtgaagttttgatttagtgttttaacaaatacccacaactgtctgaaaactttaaaaatacaccttctaccaactacatatttgcatgaggttaggtcatcttattgcttctttttctctttttttgagacagagtctctctctgtcacccaggctggggtgcaatggcaagatctcggctcactgcaacctccacctcccaggctcaagtgattctcctgcctcagcctcccaagtaactgggactacaggcatgcaccaccacgcccagccattttttgtactttcagtagaggcgggttttaccatgttggtcgggctggtctcaaactcctgacctcaagtgatccacccaccttggcctcccaaaatgctgggattacaggtgtgaaccactgcgccccaccagcttattgctttttttgtttgtttgtttagacagagtcttgctctgtcacccaggctgcagtgcaatggcacgatctcagctctctgcaacctccgcctcccaagttcaagcggttctcctgcctcagcctccagaatacgtgggactacaggtgcgtgccaccatgcccagctaagtttttgtatttttagtagagacggggtttcgccgtgttagccaggatggtctcgatctcctgaccttgtgatccgcccgcctcagcctcccaaagtgctgggattacaggcgtgagccactgtgcccagcctcatattgcttctttgaagcaaattgcaaagaaagctctagagaatccatttgtctcctattaagctcaacatgagagactttaaataatataaacaaatgacacactttttactcaactttttgttgtagaaaagttttttttcaatgaaaaacttctgttaacaatactgttctcaaggaatattttctgtttttataaactgggtcatgggttactactgacatctagttggtagaggccatgaatactgctaaactctctgcaatgcacaagacagtcctcacaacaaagcattatctagcccataatatcaacagtggtaaggctgtgaaatctaaactaaaaatagattttgaaaaaatttcaattgtataattctaccacactaaatatcaatataatcaatataaacatatactctttgagattctcaatcatttaagaattatgagagtcttaaggaacaaagaaaatacaaataatttgcttcgatattttagtaggcacaatacagcttatgatgtctagagctgtgacctaacactgagcttgatatcttgcaaagtaattagctagaataacaagacaggtttctaaaaagctcacctttgtgtgatatgatgaggtatctccaaggtcacactgtggaaggaaaacaaattcataacaatagatgttatcatttgttaggcctgcagacattttttaaaaggggggcagaggaaactctcctagcggccctgaaattcaaatcttctagttcagaacagtaccataagggcactttgttttcatttctttgttttttacaaaaatatgagaaccaaaatgcaaggaaatatgccgttagaagacgcgtttctgttggtgattacaatatataaataataacagatttcccttttatatgcttttctaccgatgaaacctttcgtcccatgcgatttattttatgtatttatttattttttgacccagagtctgtctctcttgctcagactggactgcagtggtgccatcttgactcctcacaacctccaccacccaggttcaagcgattctcacgcctcagcctcccaagaagctgggactacaagtttgcgccactatgcccagataattttttttttgggggggtggtgggtggagtttcgctcttgttgcccaggctggagtgcaatggtgtgatctcggctcaccacaacctctgcctcccgggttcaagagattctcctgcctcagcctcccaagtggctgggattacaggcatgtaccaccacacccagctaattttgtagagtgaggctcaaaacaactgagggaaggtaaatctcaattctactaataggtctacacaatattagcactttttaaaaagcctgtaacattagcatgtgagatggatatgtctatagtgcttcaagtagttttcatctctgaaataattttaaaatcacagaatttaaagttacatgctggaaaggaccaatgaccttatgtgacatttaattcaacacttgttttacagatcagggaaacaaaccttaaaactgacttgcccaaggtcccaccaaataggagcagtttctcgtcctaaactcaaattaagcagtggctctcaaactttgctgcacattaaaatcgcctgagaagctttaatatctgcctcatcttccacatgagacattttaatttaattagtattgggtatggctttgggcatcaaggttcttggtaaacgtttcccaggtgatttcaatcagcagcaaagtttggaatgattgagctggggtgaaaatcagaatcttctgggatgcttttcttcacagaaagatgcctcacatccatcccgattttcctaaaaggcttctcagtgcctagagatagagggaaagtggagatgggaagatacatgtatttgcagacttgcattttgaaaaaaaccttgcataagtgatctcagcgagttccacctatcccactgacaacagtgcactactgattcatgataaaacatttttcaatatatcttcttgaagccaatttgccctattaatttgttcaataactttatttcaccaatagtgaatacaccaaatgattatttctcaaacttgctggtggcaaattaaaacttactatactctcaaaagtagacttctaaaaagtagaataatgaggaaaaaagcacaaaattagtttcagcaaaattaatcttcaaagctgcttttgaattatatgctaacttatcaaaatctttggaactcagaagaagccagggactctagtcaaagtaatttttgtgtatgtgtgctcaaagatttaagagacttggctgactacagacatttagtgattactcaataggtcccaaagctcaggacttgagacagagtttgagttcagtttttgtttgaaacacaatttcctctcaactattgttaaaagggagggaggaaagtgacattattatgagtgtaaacttgccacttttaattgaagtaaaagttattgacaattgaattagctaaaaaggctagtgcatttgaaacaaaattgtttataagctagttatgtttacagaatgaaaagttaaattaaagataaagacattaatattctaaattagcactttccaaactgtgttctaaaaatcaagactaataacccaaggagatgagaataatgtacactggacggcccctgtggagctggtggtggtgttggttgttgttccttttaaaataaacttcatctcagggtgctctcaaagcgcatctttgtggcccacgaggtgctcatgcacaatgggagaaattcaaatgcagatacactgtggtgccagaagaagaaaagctgttccttcttccaaggataatgtccaaagtagtgcacactgatttgggcctatgatgcattgaaaaactaagtttccacaaaaaacattcaataaagggaacctatccttctcactgtgttcaacattgtctaaaggcataaagacatcaaaaagacacactgtttctgggtttgcttctttgctaactgatttttccttccaccacgacgtctaagattaaaagagaaactgatacttaatattcagaatctgaatatcaatatatggttgactccaatttcttaagctgattgctgaagaggacaaccaaatggctgaaataatttccgaataaaggaatctgtccctcggcagcatagttgtactcacgatattattgtcattgtaagataatgctggatggctgtgctgtcatcaaggaatattgtcgaacacgagctgtattgttgactgaaacgctcagtagatacctgaaggggaagggaagtgtaagtcaaacttatcaaagtgtatttttttctcagttaaaatgtcaaatgacaaagcactaagatatgtcttacactccatgaactgcctgagtgtggtatcatgtgcaatctatagaaaacccattggaggctctcaacttccagagatgatgtttaagatatgggttataaaatgctgcccttaatatggtacctgtcatcaaacctaacaaggattttatgaattaccgttaaaaataatgggaaaagtcggcttcgccgggcgcggtggctcacacctgtaatcctagcactttgggaggtggaggcgggcagatcacgaggtcaagagatcgagaccatcctggctaacatggtgaaaccccgtctctactaaaaatacaaaaaattagccgggcgtggtagcaggcccctgtagtcccagctactcgagaggctgaaacaggagaatggggcgaacccaggaggcagagcttgcagtgagccgagttcgcgccactgcactccaggccgggagacaaagtgagactccgtctcaaaaaaaaaaaaaaaaaaagaaagaaaagtttaaaatgagatttcatatttttttctacagcaataaaaagcagccaagaatttctattaattaattaattaattaatttatttatttatttatttatttttgagacggagtctcgctctgtagcccaggctggagtgcagtggcgcgatctcggctcactgcaagctccgcctcccgggttcacgccattctcctgactcagcctcctgagtagctgggactacaggcgcccgccaccatgcccggctaactttttgtatttttagtagagacggggtttcaccgtgttagccaggatggtctcgatctcctcacctcgtgatctgcctgcctcagcctcccaaagtactgggattacaggcgtgagccacggcgcccagtccttctattatttatttactacgataaaatgtagtgtattaaataatcctgctacaagagcactttattgcagtgaatacaagactaatgcatttactaaattactaatcctaaacgtattatttcaggtgatattgttacaaaagaagtgtttcagattcaggggctctgtgtgccagggctgctaggccaccaacaagtgaggaagccataggtttctctagtcctattttcttatgtggaggataaaaagagtatcacttaaatattctctcacaccctaaaaacaaatgacaacttaaaaaatctaactttcacttcatgtttaaataagactgccaagacatgactcaaatgagactcttggagaatactttgcattcacttcaaaacttgatcaattgcattctataaatcatctgacctgcacctagccattttcctgctctacccctgctctctgcctagaatactgcttttctctttccttgcttcagcaagctcgactccatctaccctcttggatctctttgtcggcagccacaccaaaaaatgtatttttatacactaattagttgaattcaccactgcttacaagatgctaattcctgcagagtattcccctcatgagaaagtatgcctctccataagagtaagggagggcccttactcttcctacctccagctgctgagcatagaattttgagtaaatccaaaacttcgacaagtgtttgacaattcagtcatcatttggaaggtaagtcttactacatttaattacagcaaaaacactactaacagtttactctttataggtattatttaaggtagtcacaaaatagaaacaaataatctaacgtcagtcagcataaatgagagtatgaaattttacaatatttaacaagaaatggaaggggttacttagtagttttaaggtttaatgacaaaaactagaaaataatcgtacctagtaatttagtaagtcaaaaccaaagccttaccatcaaaggtgcagtacccattggatgcggatgcccacgcactgacttctgctgtacctgctgcctctcattttaacccattaaaaatactaaagttgttttccttgtagacatctttcacctccttggttaggtctattccgaagtactttattttattttagtttatttttgcagctatcagaaaaggggttgagttcttggtttgattctaagcttggtcgcttctggggtataacagagctactgatttgtgtacattaattttgtctcctgaaactttgctgaattcatttatcggttctaggagctttttggaggagtctttagggtttcctaggtatatgatcatatcatcatcaaacagcaacagtttgacttcctctttactgatctgcatgccttttattgttttctcttgtgtgattgctctggctaggccttccagtagtatgttgaatacaagtggtgagagtgggcatccttgtcttgttccagttctcggggggaatgctttcaacttttccccctttcagtattatgttgttgtgggtttgtcatagatggcttttattacattgagctatgacccttgtatgctgattttgctgagggttttaatcataaaaggatgctgcattttgtcaaatgctttttctgcatctgttaagatgatcatgtgattttttgtttttaattctgtttatgtggtgtatcacatttattgacttgtgtatgttaatccatccccgcatccctggtatgaaacccatttgatcatggtggattatcttttttttattttttgagatggagtcttgctctgttgcccaggctggagtatgcaatgcggtgatcttggctcactgcaacctctgcctccgaggttcaagcgattctcctgcctcagccacccgagtagatgggataacaggtgagcgccaccacgcccggctaacttttgtatttttagtagagatggggtttcaccatgttggccaggctggtctcgaactcctgacctcatgatccgtccgcctcagcctcccaaagtgctgggattacaggtgtgagccaccgtgcctggcccgattatctttttgatatgccgttgggaactacaaaacattgctgaatgaagtcatggacacagacaaatggaaagacacccatgctcatgaatgggtagaatgaatattgtgaaaatgaccatactgccaaaagcaatctacaaattcaatgcaactcccatcaaaataccaccatccttcttcacagaactagaaaaaacagtcttgaaatttatatggaccaaacaagaaccggcacagccaaaacaaaactaagcaaaaacaacaaatctggaggcatgacattacctgatttcaaactatactataaggccatagtcgccaaaatagcacggtactgatataaaaataggcacatacaccaatggaatagaatagagaacccagaaataaactcaaatacctatagccaactgattttcaacaaagccacctaaaacataaagtgaagaaagtaaaccctattcaacaaatggtgctgggataattggcaagccacatgcgggagaatgaaactggatcctcaactctcaccttacacaaaaatcaactcaagatggatcaaggacataaatctatgacctgaaaccataaaagttctagaagataacattggaaaaacccgtctagacactggcttgggcaaagacttcatgaccaagaacacaaaagcaaatgcaacagaaacaaataggtgagacttaactaaagagcttctgcacaggaaaaggaacaatcaacagagtatacagacaaccacagagtgggaggaaatcttcgcagtctatacatctgacaaagggctattatccagaatctatgaggaactcaaacaaattacaattacaaaaatatggaaccagcccaaatgcccatcagtcaatgagcggataaagaaactgtgatatacatacatattatatatatatatatgaggaataccacctcagccataataaggaataaattcatggcattcccagcaacctggatggaagtaagactattattctaagtgaaataactcagcatggaaaaccaaatatcatgttctctttcctacgtgggagctaagctatgaggatgcaaagccataagaatgatacaatggactttggggacttgggggaaaggctgggaggagggtgagggataaaagactacaaattgggttcagcggatactgctcaggtgatgggtgcacctaaatctcacaaatcatcactaaagaacttagtcatgtcaccaaatgccacctgttcccccagaaacctatggaaataataaataaataaataaagtacagcatttttctcagcaaacataaaataaaacaaagactaaagttcatatttttcactctccttttgggcaggacaaattttagataggtttttaaagaattagtaacttttttcctttttccgagacagggtctccctttgttgcccaggctggagtgcagtggtgcaattatagttaactgcagcctcaaactcctgagctcaggtgatcctctgcctcagcctcctgagtaggtaatatgaaaggcgcatgccacgaggcctggctaatttgttatttaacctttttgtagacatgaggtcttgctatgttgaccaggctaaaaatgaacaaatcttaattaacttaaatatttctaacaccttgggcattcaggaaaacagctccatttatgttgtgaagtaatgggaagcatatggcagtggataaactttgaatgaaaatattaaacaaggccttaggagaaaagtgtaatatgcttattatagatacattaatttaaaaaattctctggcttaatatcattatactcaaattagactttgatttaaacataggtcctaaatttggattaaatataatagattgaccacaaatttatttcgtctccctctggaagcctcattagtcataaaataaaggttacacccatgaccagcacagaaggttgacagagataatttttagtaaatgctgagacataaaaagtagacaaaggagtggtaaataacacagaaacacaactttgctgactacagaaagtgactggaacagaagcgagccagtttgtcttgcagaactaaaggcaggttgtgaacttacaggcaaatggcactttggaaagtagggtaaaatgtaaaaaaaaaaagccagcaaggtcagttgcaaatctctaactagagcccaaagtctacctgtccttccatctgacaagaaacttagatgtgtgttctctggatatatcaaacctgagaatttctggctcagagatactatggcttaaacctgagatataaagaaaactgtacaccaaaaatggaactccaactttctttgctaactctgcttttcctttccaggcctgcttttactttccaggcagaaaattgggagatccttctcagaagaaactgaaatgtcttcagtaaagatccccagataatacactgaggtctcccaaatgaaaagctagtcaggcttctaaggcctcacactgagtgctatcagttaacagaaatcctgcttccaaataaagcaggccagggaccaccacacattggagggaagcctccaagaaaagagatcaaaacaatagaaaaaaggaattgataggaccagtcaaaatcaggagcaaaactttaaaaaaaaaatcttaaaacactctcaaaaaatataaaattcaatagaaatagtagaggataaagtcacagaatatcccagaactagaataaaaagacaaactgaaaaaaatagaaggggaaaaattaaaaatcaatgcaggtgtactggtctaagcagcctagcatctgaagaacaagactatcagtaaaaaagtaacagagaaaataaaaaaaaaattctcaagaagagatagtctgcaggtttagtagcctcaataaaatgaaaagatccccaacaagctgttataaaatttcagaaccttagagagagagattctaaaaagcttccgcagataactaaaacctggttgtaaataacatatcacacactggcaatagattcaagaacaacactgtaataagagcacaactgcaaaatgtcttcagaaccatacaatttagattcaacctagaggtgtactctctatcaaagaggagggattttaacatctccacccaggaaaatgtgttcaagtacaactagagacgataacaggacagaaggaaacacagaatctaggactcaggagatcccacacaagacagcagttacgtgagatcccaaaagactttaaggagttagcccagaaaagcagacattgagcatatctagggaaacccacgctatattgaactaggatgacaaaaggccaaagaaagttgccccccacacacacataaaaaggaacagatgtgtttttgcagatggaaaatatctttgaaaggcatgtgataaatgctacaatacttgggggaaaaacagctattagaaaataggcaaatgaatatagtcagaaaattagcttcatgctaaaaaataatggatgtgaaagcaaacagagcacccagaggctacttaatgatatttggatagataaactaacataggctaggaaaaaagaagatccaggagaattgcagaagtgctcagatttcagaactgtttcagagacaggatgaaggacatggaatgcagaggcacagtgaaaacaccatatgacttagcagtgaataatatttgcagagtcataatcatgtaaatattactgatttaattaaaaagtgtgctacaattggaagaaacacagggagaaacataagatcatggtgtagcgaggaagatacgcttttacccgctgtgatagaaagtcaatagacagtgctggcaattaacttaactattctatttttgttctttcattaaaaataagattaaatatttaaggcacttttttttttttttttttttttgagacagagtttcgctctgtcgcccaggctggagtgcaatggcacgatcttggctcactgcaacctccgcctcctgggttcaagtgattcttctgcctcagcctcctgactagctgagattacaggcatgcaccagcacgcccggctacttttgtatttttagtagatacagaatttcaccatgttggtcagggttgtctcaaactcctgacctcagatgatcagcctgccttggcctcctaaagtgctgtgattacagacgttagccaccatgcccagccttaaggcagatcttttgaaccagactattgaaatttaacttaaatgtcagaaatctttaaaaggtggacacgctaagctaaacacttttctggataaatttaatactcaggaaaatagaagagatttagaaaatccacaaaaagaggtccatgctaccaccaccaggtccacattgtaatttaaagaaatcaagagagacatccttttatgtcaaactatcaatttcttaactatttgagtgtttacttacatggtttgtacagttgcttcttcttatttctacaactaagaataaaaaaaaaaaaaactggtcacttctgatacaaataccataaaataaaagtagttgttaacatcttactgattactcctatgtaaaatgagacaaaattccatttaaaaaaataattttcaataatttataatttaaattatctggcatgattaatttcataagtcaaatctaaaaacttagtttttcatttagtttactttttgtttctattacatacaaatgaaagaatcctcatgtacaaaagaaaagggtaaaaaaattaggccagatgaaaaatttagctaataaaaagtttaactgttgcatatatgagccatgatccattagtattctctcattctgcatttacacatagcttactttaattatcagactctaagagctaacagctctaagaactacgtcctgaccagacacctatctctagatgcaacagaatccctgtaagcatcttgaaccacacttagtggttatctactaatatgtcactaaaaacaaatcaaaattaaaaaacggtctttacacaactggaaagtaacgtatcttaatttttttttttttgagatggagtctcactctgtcacctaggctcgagtgcagtggtgggatctcagctcactgcaacctctacctcccaggttcaaccaattcttcagccttagcctcctgactagctgggactacaggcacgtgccaccatgcctagctaatttttttttgtatttttagtagagacagagttacactgtgttagccaggatggtcttgatctcctaacctcgtgatccacccacctcagcctcccaaagagctgggattacaggtgtaagccacagagcctggcctaaattttgatgttaaaatgagtatacaaacctaattggacatggtgtctgaagctcaaaaaatcattttttttcctctaaaaagaggccagaataataaaagccccaagagggacttgggccatgctttgtttcctacactgcctctgcctttgatgctggaagggccttgtaggcaaaagttcctaccaccgaagagtgagggacatggaatagcttttcttttactgcttccatgctctctaggtgtgagaagcccatggctctggaaggaactgggaaatacaattctgatatgttttggatatgttgcccctccaagtctcatgttaacatgtgacccttaatgttggagacagggcctagtgggaggcatttgggtaatggcagtggattccttatgaatggcttggtcccatccccatggtaataagcaaattctcattatggtaatttaaaaggctgtggtactggccaggtgcggtggctgaagcctgtaatcccagcactttgggaggctgaagcgggtagatcacttgaggtcaggagtttcagaccagcctggctaacatggtgaaaccctgtctctaccaaaaatacagaaattagccaggtgttatggtgcccacctatagtcccaactactcgggaggctgaggcaggagaattgcttgaacctgggagatggaggttgtagtgagccaagattgtgccattgcactccagtctgggcaacagagtgagactccatttcaaaaaaaaaaaaaaaaaagagtgtggtaccttcccccttcccctctctctttcaccgtgtggaaccacctgcttcccctttgccttttatcatgattgtaagtttgctgaggccctcaccagaagcagatgttaaagccatgtttgtacagcctgaaaatctttgagccaattaaacctcttttttgttataaattacccagccttaggtatctctttatagtaatgtaaaaaatgaagacaaattctaaccagaaataactgactcaagatgggcaaagtctactcaaactataaaaacaaaggttacaaactcccgtgttttactgtgctgcattacttcgcacactattatagaaccctcacttgtattcttgctgtttaagtcaactggaaaacttggctgtgtatggcttgttggcaaataaatgaggatttaacataacattagggaaataagcaggagtagggcatgtttaaatttacatgacatcaaatgaaaaagttaataacctaaaacttttgagtagcatgaacttggatgtggtaaatgaatgtggtcagaggactgtgtaagaggaggcccaaatcacagattcaatccctgatgataaacaactatgttttttaatttgtttaaatgaaaaccaagctgaagcctaagttctatcattcatctttaaagtgtactttttggagcaagggaaaagggattataaataaagataaatccattaattataaataaagataaatccaagaattataaagagaaatccatgactcctccaacacatgacaaattaattgtgttgataaaaagatggcaaaatgtataaacaaaaaggttacacgttttcactaacatcataacaactaaaggaaagtatatcacatattaaaataagacaagtgaacatgtgaaaaggtgaaaaatttaaaccaatatgagtttttctaaatactttctataacctgatcaaacaagagcttttattctttctcttggcggaaaaaacaatgttgtctcaccatctgtttgagagttcctctggaatattgtgcttgcctctggattggcagaagagttaaactccaaagctatatgcatagaggaagaaaagaaaaagagatgcaatcattgataaaaatttatcaactcgtttattcggctgctgcatttaggctatttcactatctctactttgattcttatccattgaaatgaatgtatagacataagatagagccaggcaagatggcacatgcttgtagtcccagctactcaggaggctgagatgggaaaatcacttgaacccaggtcaggaagttgaggccagcatgagtaacacaatgacaccctcctttatttaaaaaaaaaaaaaaaaaaaaaaagaagaagaggtaaattttggctttgagttgtgtaaaatcaactttgcataaaataaatcaagatggcagtaagttttaaaagacagtctattttataggcaaaatataagatgtattctagagtttttaaaatttttaaaaagtaaattcatcatatctgtcacttccatttcattctgaggacacagaaccttagttctcttgagtagctgtcttccatagtcatgtgatatctctaagttttcatttcttcattagcaatacatagggagaacatacacaggccttatttgtattggaaagggccaagtgagacatacataaactgtgttgtaatcctaaagaatgacaataaagagccatttttgggctctcatccaacactacccatctactaactggtgtgtaacatccatcaggctttccaaacatcaccaagcagagtataagtttatacaagtacttacatgctttgtgtataaaggtacaatcaattaattcacacaatgcatttgtttattctaaagcaatccttaaatatcttgaaatgtgaagatagtacttccaagttacaaagtcacactcataatgagtcttaattatcctacctctttaaaaattaagagcccaaccaaagtttaaatagaagagctataagacatttcctctagagtaatgaaatctctggcatttaaatgaaaccaataagccaactggatttaatatgtttatgatgcaatgttttctattttgaaaatttcagtttttattcaagaaccatattattacccagaattacttttacttagattcatctctttgcaaaattttagaggcaaaccaactaattgttttctgttttctaccggctcccatcccctgcctctgccaacagtgtagagactaaaaaactccaactctttccttttttttttgtgagacggagtctcgctctgtcacccagcctggagtgcattggcgtgatctctgctcactgcaacctccacctcccaggtccaagcaattctcccgcctcagccttgtgagtagctggaactacagtcatgcgccactacgcccagctaatttttgtattttcttttttagtagagacagcgtttcaccatgttggccaggctggtctcgaactcctgacctcaggtgatccgcctgccacagcctcccaaagtgctgggattacaggcgtgagccaccaagcccagccaaaactgtaactttcttatctttgaacaagatgctattgtcaggaggggaagggacaaagggggagccacggcaacaaacactcttacagggaagtctgacattttaacctgcaatctttatattacacattaaaagtctacgttgacgtttcatgtcttttgaaagttttgaccgtgaaccaatccccacctctcttttagaacaaggaggtaaataaagtctgttaagtcaccagaataaatctggagacacattttctgttaaagtaagaattttaaagtaatcagagcctcataggtaaactcctttgagaaaccccaaacacacacacacaaccatttttctgcagccccggctgtgacattttatacctttcacaattattttaagcactctccttttttctttttccttctgtgttcaaattacagttagaagaaactaagcagcttctatcaaggtgacttaaagcagcccattaagaataccatatagcctctcccgtggcaacctccattctgattttaaataagaaatccccaaatatttgaataggaactgtcctgagatttggctactttaacaaaggaaacaattaggcacttacctggttccttcacttaggtaccatctggataggttcaaagaaaaattaagatgggtactgaaaagttgggatatttgagtttttattgagaaaaggaagagaatagctcaaagaagcctaaacaaagtcccacaggataataaacagagctacagacactgttgtctcaccatctgtttgagagttcctctggaatattgtgcttgcctctggattggcagaaaggttaaactccaaagctatatgtatagagggagaaaagaaaaaggacgtaatcatttataaaaatttatcaactcatttattcaactgctgcttattcgacaagagccataaataaatggtcccatgccagcctgggagaatgagatgagagagcaagaactgggcgattgggaggggaggtgaaaagaaactgactggactcggtggggaaagactaaggggtgggaattcaaggcagagccagcttttgttcctggccagcccccgggaaagctggctacaagcagaaaggagctcgaagtgtgggatgcctcaaagggaaccttggggacagcagcagccagaggcaaaccgagggtagatggcacctatcacctccttaccttcaggcatctcccggtcacgaacctggtgcatgtggaggtcctcaccaacttcaacagtcacctcagcaggctgtacagcagcagccatgggcgctcctgccatcctgtcctcagctcctgcctcatagatctcagattcagagggacacaccgacccctgctgctggtcaaactcgaggctgacgctagggtgcacacgacaggtcagtatgttccccatggggcgcctctactgtctgccaccacctgtgcctctgctcacagctttggccacgcactcccgctgtcctaggccgaggctatgctgcacttgcagagatggtcttcccgctcctcgcctgcccacctcacagtgcggccccgggcaccagccctggccccggccccggccccggccccggctagggctgcgggccaaggcccgcaccctgctgcctcccctgagttgacttgtctgggagggtgaagaccagccggcttatttaataggttgtgaacccaacaagcgctgagagacacaacaactgcctgaagagagaacagacggagctcctcctccttctgtagtcacctacagactgaagcccactggccccaggtgggagcccaggcatgtggcacacaatgccccaccccacacttcacaatgccctccccgacacctcacagtgccccaccctgcctgccacccctccccaacagctcagaatgcccctgccttggctgccccaccctgtggcttatgatgctgctgctctcctggcccctcgtgcagtgccaatgggactaaggttttcattcatcaccagcttcctgagattttagtcctaagaaaagcacagggtagttcattcctcgaagccagcttcctctacgagttctacacaaagcctcagtagagtgggtcccattagcaaccaagttgaacaacttttatttgctgtctgaatatagatacacctgaattgttgactgcttttgtaactaaacactcctctcctgtcttccaacgagtggtcatttttgtccgcaacttgatcacagcaatccctggggccctagctctactctcaataaagagttatggctgtgtgttttgaatgacaccttaggacccatcctgcctccacctccttctccataaaatagaaacctaacttgtccctccaagctctgaaatgctgaaacttaccaactcccttttctccccgctatttcttccttccatggcagggactttcagattttctttcttttactaacaaggcactaaacatgattttctcatacaaaatcgagagccataaagtggcttaccacagtcctatttcaataaagatgaatactcgacatctggcaagtagtgtgtgcctgacagtgtccccactgtgctatgctcatttaaccctcagaaacaatctcatgttacagattttacagaagttgttgggacagagaaggtaagtaaacccccccaaggtcacatgactgctaagggtggggccatagtttgatcccaggtagtctgaattccccaattgcttaagcatgattatcagaaagtatagcagtctgttttcacactgatataaagaaacacctgaggttgggtaatttttaaaggaaagaggcttaattgactcagtttcacatggctggggaggcctcaggaaacttacaatcatggcagagggggaagtccttcaggaaacttacaatcatggcagaagggcaggtccgacttacatggtggccgcacagagagtgggaacatgtgaaggagcaactgtcaaacatgtataaaaccatcagatctcagctgggcacggtggctcacacttgtaaccctagtactttgggaggccaaggcaggtggatcaactgaggtcaggagtttgagaccagcctagctaatgtagtgaaatcctgtctctactaaaaatacaaaaattagctgggtgtggttgtgcatgcctgtaatcccagctactcaggaggctgaggcaggagaatcactggaactcaagaggcagagactgcagtgagccaagatcgtgccatggcactcctgcctggacaacagagcaggactccatcccaagaaacaaaacaaaacaaaaccctataagatctcatgaggacttactgaatatcacaagaacagcatgaggataactgcccctgtgatccaatcacctccccctaggcccctccctcgacacatcgggattatggggattataattcatgatgatatttgggtggggacatggcaaaaccatatcagaaagtaaaggtagaagtcaagcttggatgggaaatgacattgtagattattattattattattattttgagacgaagttttgctcttgttgcccagtgaaattgtttctctaatttcattttcagattgtgtcttgtagatgtatagaaatacaattgataaatgattctggctattaaccttttatgcttcaaccttgctgaacactatttttttttttttttttttgagacggagtttcgttcttgttgcccaggctggactgcaatggcgtgatcttggctcactgcaacctccgcctcccgggctcaagcgattctcctgcctcagcctcccgagtagctgggattgcaggcatgcgtcaccatgcccagctaattttgtatttttagtagagacggggtttctccatgttgatcaggcccacctcagcctcccaaagtgctaggactacaggaatgagccatcgtgcccagccagattcgtatatttttaaaagaattttttttactttttattttttttttttttgagacagagtctcactctgttgcccaggtagtggcacaatcattgctcactgcaacctccacctcctgggtccaagtgattctcattcaagtgcctaagcctcccaagtagctgggattacaggatcccgcccccatgctcagctaatgtttgtatttttagtagagatggggtttcaccatgttgctcaggttgatctcgaactcctgacctcaggtgatccacctgccttggcctcccaaagtgctgggattgcaggcgtgagccaccactcccaaacagaacaacatttttttgatgtggattttaaaatgcctccccttctttcaacattaagtcccttctacatgccaggcactgtatgtgtgaaatagtcccaactctcaatgagtttaggcagatacacaaacaaaggcttaaggaggtcagttttctgagaccatactgctggacagtatatgaacctgggatacaaacccacctctatttgacctcaaatttgatgctggggtggttttaattttattctgggaatttcagtcattcaaccataaaaaggtgaaaagtctctgtcagatgtgcgtgtagtggtctgtataataaagactgaaggaagcaaccaaaccaattaagagactttctctaaaggcagagtaatgctaagggcagtggcagtgacaaaagtggaggaaaaagtctgtgatcatttgggagacagaataggaagtgcttggtcatgagatgtgaaagaagaggggaagtagaaggaaaacagagctgctcaggctctgctggggaagactgggtatgtagcagtgccttcctcctggccgagaatgtaggaagagaaataggtaaggaggaaaagatagttttttactctcagtgtcacattaaaatggaactctctggtcaaaagttgaatataaatctctgtaggctaagtccatttgtgacatcccaacatatgttttcaaaaataacatacacactaaatcaagccattaagcgtaactggggaaatttcctaaaatttacatgctaaaaaatcaccatttttcatttattactttcatggagcaactttgaatctatggttacagcaggtgaggcaccttgtataaaataaagctaatacatgaaataaaaccatttaaaattctattgttctcagagaatggagaaagcaattgaagccatgggtgtggaggtgactgccttgagaagttgtgtatagtaaggagaactgggaagaaagaagacctggagaatagggtgatttgcacggcattaagtgaagcttgaaaaagtgagcactgggagtcaagagacatgtatgaatcaggaatggctgctcctgtgagttgttagaaaggagatgatgccttcttttcatatctataacagtagcacctagcacagtgcctgttcaataggtactcgacatgtattatcccaatgcagagtcaaattttgccaggaaggcaggaaagctacaaattagctatggcaacttagtgattgggcttgtgtgtgtgtgtgagtgagctggatgtcaggcagtgggcaaagtagtgaactggaggtgagaaaacaatgacacaaactcagggcttctcttcccaagtatttggctgagaagagagatgtagtattaaagggagatatgtggtaaaggaagacttttatttcaagattcaacaaaagcgtgagtatacttctatgttaaagggaaagagccaatagaaaaaacacatttttgaggttagaagagaaggaagaactaatgcagaagggccccaaaaggcacaggtgcgtgcaatccggatcagggacagattagctttggattcctacaaaagcaagaagggagaaaggaccatgtgacactagagctatttctggtaaaggaaaggtttgggaaaagatcttttgatcacctttattttaacagaatgtttttttttttttttgagatggagtcttgctctgtcacccaggctggagtgcagtggcacgatctcggctcactgcaacctctgcctcctgggttcatgccattctcctgcctcagcctcctgattagctgggactacaggcacccgttaccatgtccagctaattttttgtatttttagtaaagatggggtttcaacgtgttagccaggatggtctccatctcttgacttcgtgatccgcctgtctcggcctcccaaagtctgggattacaggcgtgagccactgcacccggctagacttaaaaaaaaaaaaaaaaatactgtgggaaaaaggatattatgtatagaaaagtctacacttcttgatacaactaactaaaaaaagcctgatacactaaacaaaacccaaataatgtcttccctaaaagtgggtaacttgaaaagcaattcgagcaaaaatcaaggagttcaattataaataagtatatcaacaaagtgaaagatgggtttaatttttcccacaaaaagttaaaagaaataacagcagttttagaggaagaggaaaaaataataagaaaattacatgcagttgcaaaatgtgtgactatttacaaactctaacatataactacaaaacggaccagaagaatcattatcataggaagcaaagggtcatttcaaaaatcagaggagggatgattcatatttaatttaattctgtggaaaaaatttaagtaacctttgaggacaaaaataggtgatatgttgaaatgcgggaaaccacagtggaaggaaaaagaattcaagaaagctcagtttcagtaaccagtatctagtaaaatcttcaggacctagaggctacaatctgcattaatagtgtctgaagacctagaaatgtcattaaataccattttggataattcttgtagacttgagatgatgtctatttaaagttacaaaatagtgcccgtatttctgtattcattacagacaacaattggatatggaaaagaaactaacatgctatgccacaatctctaaagaaagattagggatgtttcagcttaaagcaagaataatcacaataaagttttacgaccctttgcaagcatatatgaaaaacttacaaaaagtttgtaatgatcttttcttaagctaagagaatggaaaaaatgagaaaaattaaattataaaatgaaactttggtttagaggtaagaaacatttgatgacagtcaagagatcagggttgtacagtgtattatgtgaatgttgtgactcattggtttcatcttggatatcataacttgacattttgtaaaagtgatttttcatgggagttttttcaggtgccctgaaaagtcctgtcccatgagaagcgaataatagtcttccatattcttgcgatatcttaatgaatagcatcttctacagtcttccattgtttagtccttggagagacactgactgaagctgtgaggtttcacaatgacatgtcagccaaatacatatgctcagatttaccatttatcaagaggtcttcacactatcaattgtgcaattatcattctacacacaggcagtgataaagggagtaaaaaaccacagccatggatcgggagaccaaggtacctccagaggagtccagtgggtccagaagccctttggatgttggtcagaggctcctcttgggcagagatcacagcagcagccaacaggtctggtgaaatccttaagagttctcatggacaaagcttgtgaaggcatcttagacaagatcttgtctttgctggttttatgatcctctgcagatgggtctattctcattatctcagccacctttcacttcctatcagttcagttcaggtctctcatgatcccaggcagcagtagttgttatcacgtgagttcattcatatatgtttatctctttggggatggggggacaacttcactgtggacttaattctactggagatgagtgaccccattttaagacaacaggatcacaaattattatcacatatcagcagggcagacaatagctacgacctggggctgaaagcaggtaactccatttatcctgtaaacattgtcttgattatggtgccagttgctgtgagggatttcctttccaccacctgtttttcacaaggtttgagtctgaactgctaacattctactgatttctgggtgaagggactgactgcaccatcctaccctgtcagagcacttgccccagtacttccactttaagagttttccaccttgtccagaactacagtccattaatcccctcattttctctcttaagagaataaacaggccaggcgcggtggctcacgcctgtaatcccagcactttgggaggctgaggcgggtggatcatctgaggtcaggagttcgagaccagcttcgcctacatagtgaaatctcgtctccactaaaaaaaaaatcacaaaaattagccgggcgtggtggcaggcgcctgtaatcccagctactcgggaggctgaggcaggagaatcccttgaacccgggaggcagaggttgcagtgagccaagactgtgccacagcactccagcctgggtgacagagtgagactccctctcaaaaaaaaaaaaagaaaaaagagagaaaataaacaacacatctcaagtacacacccacatccctcttatcccaaataccaaacacacaaaaatccaatctgtctccttctacctaagcaattttagatagtcactgtctcataattaccttaagctccctgacttgctgctcatcctttctctggcaaaatctcatccttggatgagcccgactttgtgtttgctcaatgacaccactcacctgaaccagaaaaaatatcaaaaagtggtcagagatatcatcataaattcaaattacttacacaaaaaattggccctaaatgtttccagaaatcaataaaagttttgtttctccaatgacatcatttcttcagaaacccaatgtgtataacctattttttctatgttcttctaacatttattcaacttctctcatctgatatcttgccaaatcattcaaagagaaaatatatcccattaggcaagagcccaccatattcccatcacctgagaaaatcatatgcacaggatgcacccacctcacctttctctgcctcatcatgtcagaaaaagtaccccaccttttgtcacaaggcaaacctgagataaaagatttagatggcctgtaattccagcacttggggagaccaatgcaggcagattatttgagtctaagagttcaaaagaagcctaagcaacttagggaaactgcatctctcaaacaaatacaaaccattagcctagcatggtggtgtggtggcacatgcctgtagtcccagctactcagggtggggagcactgaggtgggaggatcacctgagctggaaggttgtggctgcagtgagccgtgatcacgtcactgcactccagccacggtaacagatatttttaaaaggatcttctctgttaaaaataatcaaataaacaggtggccatgaggctgaggtggctgccgtgcactcaattcctccttaaataaaccaaaacttgactcagtgtaaataataaaaggaaatgtaagaaccaatcagaaaccaccaactaacatctaactagagaccttccactgtaatgttccaaatgaggccactgctccacttcacccaatcaagtattttctttttcttccacattcaccatataaaattcttcccccaccctccctaagcctctctgtgggacctctgagctgcttgcagtctggggctgcctagtttatacatttctgaatgctcaagtatattttctaatgtttcaaagtggctctggtgtaggaggttgttggtggagtgacccgagagtatacaggaattgagggcatatgagatctctggactctgcactccattttgctgtacactcaaaactactctaaaataataatatatctttaaaaatctataactagcacgtagcccttttcaagcctccaactggttggagccagttcgattaaagctcagaagaaaaactggttaataagctagttctgacccaactggcaagaagcggcaggaaagacccaggccaggggagcatattgcacatgcatgcaccaggaaactggaggaagcttggaggccctttagcctggtcctgagcccgctgaaactgcagttacagcacagatgcctggggcaccaatctgaatctgccaacatccaaggccacatgaacacaaatgcgcagtctcctctgcgatcggtagctaaggatgttaggccatgattggactaggatgggagatgaactgagaactatggattctgtaggttgttgttgtctcttcccaccccaagcaacaagtgatgaacacacacacacacacacacacacacacacacacacacacacacacatcccgtagtgactaacaggatctccctccaggggatttgcagaaaggggagcagaaaacatcccaggggcctttcacagctacttccttgagccccctttcagactgctgtctagacctgtcgcagcccaaacatcaccaccctgatatgcagaagctggcatccttacctgaaattcaacaccaagaaatgatctcttctactcaacactgatagaaatacctctaagcaatgtcctcattggcaggggtggagtgggggagtttcttaaaaagtgaggcctctgcctaccacctagagaacctggaaatttccatctgtgccacaaagtccaaatcactggccactgccccagtgtatggcagattagaacatctctccattagatctgggtttctattccattgagtgaaatggcttttctattacaggaacagaataagggatcaaaagggtcttacaactgaactccagtgtacagtctgcacagacactaggcttgtgcaaatatgacacagcgaggccccaggacccttaagccagctgaatgtactgagtttcaggaaacagtgagatacgttcagcaaaacagtgggcttcatgctgaaagaagtcattccaagtaaacacacatcacacacacacacacacacacacacacacacacacacacccccgcagacaccctagtggccaataggtcctctcaccaaaaacctgtgatcaggagagcagaaagcctcccaggggtccatcactgccctttctggagccccttatcagatggccagccccaggacagcactgtctgatcctggtccagtccaaaccaccatcaccctgtgatgtgggagctggccacttcaccagaacctctgtgtcagaaaaatttctcttccttttaaaatgatgagggggaaccttcagacagtgtctgattagggtgggtggagagaggggtttcctagaaagtcaggcagggcagggctgaagccctctgggttaactgagtgcttttgatatgaaggcaggtaagactggacaggtgggggtgttagtgaggggatggtgtagggtgtgctgaagaactccacttgggctctccacaccagggaaaatgaccataaaacatcccatcttcactgctcagagaaggctagatctgctgtgagctagaaagccatgtgggggcagctgatgagtcatcaaatgggagaaatctgagagccatgtgttccacaggcctctggtccttgttcaggcagcagggcactgtgacatgtggctccttggccccttccagccaccaccttgattgcatgctgcagggaaagagactgaagaccaagaatggggtcttgctcaccatgggatgatggctcagtacagagctgagctatgtatggcccaagaggcagaatgtggggatgacccaggctgagctgggggatccaactgaacatgcacttgctaagaagctgtgggctatgatgccttgggaccccagtctgggtctagaattgtagcaaaacaggctactggtaaaagttcttgagaagccaactcacttttgctgtcatccatgggcaaacaaaccaagccccaccacttcccactccctctgaaagcctcctgcccctctgatcgaccacaccacaatggtgtcactctgtaaggcacaggtagacaaggcatccagccatgaacactccagggcgcacacatgtccagaatacgctggttcttgttgagactccactcttccaactcagacagaagctccccaatctcctcagccactcccaacaactggaggtctgaaaactttcatgcatgccgctatggtctaaaccactcgtggcggttttcattttcattttcctgataatcagtgatgctgagcacctttccatatgccttttcaccaactggatgccttctatggctaaatgtctattcgaatccattgcccatttacaaatctgcttttttgtgggcttcttgatgtttttctctttttttttcctatttatttatacaagttccttaggtattttggatattttttaaaatcattttcaattccactgcccagttataatttttttttttttttttttgagacggagttttgctgttattgcccaggctagagtgcaatggtgcgatcttggctcacagcaacctccacctcccagagtcaagcaattctcctgcctcagcctcctgagtagctgggattacaggcatgtgccaccatgcccagctaatttttgtatttttagtagagatgggttttttccatgttggtcaggctggtctcaaactcccggtctcaggtgatccatccacctcggcctcccaaagtgctgggattacaggcgtgagccactgtgcccggccaattatccctttttgtgtttttttggggggttgggggaagaacagagtctcactctgtcatctaggctggagtgcactggtatgatctcggctcactgcagcctccgcctcccaggttccagcgattctccggactcagtctcccgggtagctaagatcatgggcgcgcaacacatgcccagctaacttttgtatttttagtagagacagggtttcaccatgttggccaggctgttctcaaactcctgacctcaggtgatccgcccacctcggtctcccaaagtgttgggattacaggcgggagccaccactcccgaacccattttgtgttttaacatcagtcaacactcctattttaaaataataacaatgaatggcggtaccttagaacaaaggaattatagatctttctcttgtcttagtgcagacattttgtctataaaatgttattcacagatgaactcatgagaacattactgtgaattttaaatccatatacaagtgtatgctcattcatgaatatttcaataaaataaaactaatagcaaaaaagaattccagagttgaagcagtttcaggaaaaaggagttggcagtatgaagtaaaatagcaaaaaaaattttttttttaaatgggtatatttgtgtctacaacttttttttaattatagcattagacaatgtgtatatagatacgtatataaagcaatggaagtggcattgttttcatactagtctagaatattaaaaaatatgtaatatgtgatcagcaaaataatggccccccaaagatgtccacagattcctagaaccttacatgaaaacggtacatcatgcatgtgattcaggtaaagaccttgacatgaggagactaccctggtgctatggaatgaacgttgtgttccgtcactgttcatgtgttaaaatcctaaccctcaaggtgatggcattaggaggttaagccttacgggagactctgccctcatgactgggattagcaccttattaaaggcacaagggagcttgtttgttcctctcaccatgcgaagacacagcaagaaggaagcctctatgagaaagcaggccttcaccagacaccaagactgccggcaccttgatcttgcacttctcagcctccaggactgtgagaaacaaagttctgttatttataagctacctggtctaatgcatttccttgtagcagcctgtatggattaggacagtgggctcatgtggatgatgacggtgtctccattcaggactaagtaagcacatgagtccttaacagtggaagagaagggggaaggaaagagccacagagacatgtggccatagaagaagggcccatgggatgcaaggttgctaatggtgagagtggagaagagcccaaagccaaaaaatgcaggcagactccagaatgtggaaaaggcgagaaaaaagatcccctagagcctctagagatgaaggtagcctttccaccacctagattttagcccagtgagatccacatcacactctgacatacgggagtgtaataaatttgttttatgccctgacatactggtagtttgttgtagcagcaatggactagtaatatataaatatatatatacacacacacacataaacactacccccaccaccacacacacaacataactatctatatataccccgcccttcaaaactgaatcagataaactacacattagcattaacttagctgggtgtggtggcacatgcctgtagtcccagctacacaggacgctgagagggaggatcacttgagcccaggagtttaagatcagcctgggcaaacacactgaggccacatttcaaaaacaaacaaaaaacacaacaaatatttgattaagctcatttcccaaatttgaagaggaaacaattattagataaagaggagaaaagagaaaggtagagctgctgacttctgtggtggaagcacaggcacaggcccaaacatactcctgtcctcctggctttcctgtcccttctcataagggacacaggaacctctcaaactgaaccatggatcacagaaccatactcagaacgcaatacagttttgtctacaattttttatatatctgtgtccctgtctctgcctcccattcccaactcccttactcttgttagaaaaaaatggctattatcaaatatgagtacatccttatatactaatgccaactgatcaccagctggttttcttcttttacaaagtcataaatatttaggctttaacacatcttccaagcaatagaatgttattttccagttcattaacacaaattctatatctaaaatgaagacttcacaagttgatttaaataacatattaacgaaaatcgactggccatggttcaaactgacattttaattaaatgtgatgataggttgagtaacctagcagtactctaaaatgacttttggttatggctttttccatattatgcttaggctgaggcatccctaaatgattcaattgtaattccccttcttaaacatgagatttatctttacaaaataatttattttcttaaaattacaagttaattctatagttcatgcatacataatctcagtagatatcagctgtatgtgtacacacatacatataggtatttgtatatacacatattacataatttaaaaaaaacttattagcagggtacaaccacgaagacaaagaggctttgtgtaatgtgatggaaacacaactgcaggacaaacaacaggctgctgtgagggctgtatttaccctttctgatgtaagacttggaaaaacatggatactggatatctaatccccataacagaaaatttagggtgcagaaaacttcccacaatttttacagacaatgtcaatagaaaggcattcaatgcagggaatacacagtgtgacagtatacaaaaataagcaggttgatggtttagatttatgagacaagagaaagaaatagtagatgatgtcataattctccttttatggagttatgaaaattcttcattttatataaggtcaggtgctttcaaatgtcaatgagaaaaatatttaaaggaagaatcaaatctaagacgtagagagatctttataaatgtgaacttcaggccaggcacggtggctcatacctgtaatcccagcattttgggaggcctaggtgggccaatcacgaggtcaggggatcaagaccatcctggcccacatggcgaaaccccgtatctactaaaatacaaaaaatcagccaggagtggtgacgtgtgcctgtagtcccagctactcaggaggctgaggcaggagaatcacttgaacccgggaggcagaggttgcagtgagccgagatagcactactgcactccagtctggtgacagagcaagactccatctcaaaaaaaaacaacaacaactttttttcatgctgagaagatataatcatcaacacattcttgagcacaactatgcacacaggcacttccgcattcacaagccatgctgtgtgcacacactgatgcccctagattccttttttgaagaggtggtctcttggtgtgtcacccaggctggagagcagtgttaggatcatagctcactgcagcctcaaactcctgggttcaagtgatcctcctacctcaggctcctgagtagcctgaactataggaatgagccaccatgcccagccaatattttcatttttttgtagagatgaaatcttgctatgttgcccaggcgggtcttgaactcttggcctcaaggaatcctcctgccttgccctcccaacatgctgagattacaggtgtgaaccattgtgcccagccaccggattctttattaagaagaaaacttgtttgctgacatgtaggcaatgaattgatgaatagtagttcataaattactaatttacaagtcaatataaatgagttgagtaaacacaaaataacagcataaattaataaacagtttacgacctcaagtttctttttttcctttaaaacattgctctgacagagactactacttgtccattccatggaaaagtcagaggtggttaaaatgtcagaggtacacttattaacaccttgctgccttttgtgtagcttcctctcagtacttcaccagttgggattgacacacctctccagctgggttcaggagccagacaggagcacacagaacagggaatccaaagccatctctgacaccaaaagcaatgaaaacaaaaataaccaaacatattatcaagaaatgaacaagagatcgatatcaagtacagcaaaaagagaagaaatcacttaatctgccaggctttcattctgacaaaataatttacaacacgcatgtctctatctgacatgtgtgaatagaaaaataagaggtgacaatagagtagaggattcgtcttccaattgtctctgatctatccaacctttgttacacatcagagagctctccaatttataaataaacaacagagatatgcggcaaccaggacacagagacatactgagagtactgctcagctctctgcctaggcctgattctgatgatccctgacaatgagcactgtgaaatttacagcaaatcagtacacatacacacaaacacacaaaagagatacttcatgggcaaaaagcatcaaagatataaaataaaatgcctgaaagaccataaaacaacttctgatgaaatgctgttttcattttgcagtagtaaaatattcaccaccaaatctacaattagcttaaaaattacaataagtacagtacttttggatcccatctccaattcacaccttatcaacatgtaataatcacactgcatctacaacaaagctggatggactttatgtgctgaatacaacttgtacactaagaaggaaattttttgaaataatgagaatacaaaatttgtatgccatgctctacttcacaagttaaaagaaaatacaatcatttctatttttaaaatgcatcgaaataaaatacagaaaagagtattctaataccagttaacattaagagaatatatctctaaaccaaagatcttggatcttctagaaagacaaaatcagctggtatatatttggataagaaaaaaaaattaagagatcaagaaaggagagaagacgttcgcacagaatcatctccaaaaatggctttctgacgcattcgaccagttttcaagtctatttgtttttcctcctttggcatcaacagcctatatcaccaaggatatgcaaaataattcaatttgtacattaatcagctaatctagaactggaaatatagtcaatgaaaatacaaaagaaacagaaaatgtcaatgaattgcttaagatgtttaagatgacatagcgtagggaaaaaatgatctgataaacaccggaagagttaataaggaaactgaggcatggttccctaacaccacacttcaaaagaacttatagagagaataaaggaataacccttaaaaaaaaaatctaattttagaaaaaaattgctcaaaagggaagttagggttttatagatcttctggaaagctgattaatttctaagctaaaaacgcatgatccttaagagaaatggctgagtccaggcccaaggcaggaagaggacaaaatgagcctggatcctctggttctgtcagaaagtaagaaatgctcaaagactaacagagacagttgaagggacacaggagacaggccgaaggctcccgcagccgaatctgggacagcataggcatcagaaagtacaatgacagtgatggaaaataacccatggaataaaacgcaagtgcattagtcagccgtgatgctgaaacaaaggggagaagagaaagctctttgttaaaaatgccaggtaacaaacttagaaggaatgacagaggaataacatccattttgagtcaccagtgccataactgatagagaagattatcagggggctaaaatcactggatgaaagaaaactatatgaagctttttaacgtagcacaatagataaaagtatgaaaacataaattagaaaaaactaaaaatcataccataagggatggataagttagaatacaggaataacaggccaggcatagtggctcacatatgtaatcccaggattttgggaggccaagtcgggaggattgcttgagcccaggagttcgagaccagcctaggcaacatagtgagaactcgtccctagaacagaacaaaaaaaattagccgggagtggtggtgcactcctgtagtcctagctacttgcggggctgaagcaggaggatcacttgagcctgggagttcaaggctgcagtgagccaagatcacaccactgcactccagcctgggagacaaagtgagaccttatctcaaaacaaaaacaaaaacaaaaacaaaaacaaagaaaccacaataacaaaaaaacactggtaacaataaaatcatgattacataaagactgtatagaaaaaaaatcctcagaatatagaaataaaattatgtattttacctgtagctatattagaagagagtattcttgtagacaaggatgactagaaggatatgcaaaaatgaaaacagctaataacactcattacgtcaggcactgtggtaggtagtttatgcacattgtaacaaattatatactacattatctcaagattttcagataaattttactgggagtcataaatcaatacaacaaaatcaatgttttgcaaacatccactaagcataaaggtatacaaattcccaacccagactgaaaaataattcacataagccacacattagtggaaacctacccatgggagataatacaacataatctaaataaaactttcagagacaaggcatgtggcttctggacagccacaaactccctgactctgctctagtgtttcggccatcaaaagaaagccaagtggcctcaggtctctgaaaaaccaaaaaagcaacctatggaagatggcgtggtatttgaggaatatttgaagtctgttgaaaaatgcatcctgtattttttttcaagataagactcccttgtaatgtcaggtaagtgaagagccctcagagacacatgcacacacaaagaaaaacaaaacgacatagaatgaatcccaccaaaatgtgttatgatggcagaattatgggtgatacaatcttctgtaatatatctttttattaaaaatagaaaaaaagcagacttacccttgattatctatagcctctgacccaagtggtttggaattggaaagcagcgtcactcgacttgaagccatcttggcatcaatggtggagtaggtggagatgagactctggaccagctcatgggtgagccccaccttgtcctatcaaggccaccaagaaagggcacgtgaggaaagcacaaagatcctggagagacactggtttcactcagtttctcaaaattatcttagacacatttcctgagatcttttcttaatgccacaaacaccagagaagaaaatccttataacaaagcttgaaatggatccccatctccattaaacttgtccaaagctcagtgagtatataacctgataacctaaacacctagctagaaaaacctcagttccagtgctacaacagtgctagcttttctaacatttttaaataaccctgcttttaacccaataaaattcaactacagaactaagaaataaatattggaaatccactttaaaataatgaggagaccactgtgattgagaaaaagaaaaagacaaacgagagctggaaagcacactgattttgtagaaacagaaataagccgtgcaggtgccacactggcagcagtgcccgcgctggggccacggatcaaggaggcatggaggacaggactcttctgcttggtacaatgaaaaaatggtattctttttattctacatattgacaatatgcatttgggcctttattataagtacaagagaaaaatcttcaataaataaaagctgagtacattactttttttgattaaaaaatagattaggaaagaataatgagagttcagagcaaagactcctgcctcactgatgcctgaaaaccgtggctgccaccaaggtcaacacagacagcgtctttgtcatacagcacaccctcaactccagaaacaggcacataaaccagctgctccttcttatttaaacagcacttcttttgttattcaggaagaacacaagggtctgggaggaaaccgatgtcactcatggcaaaatgttctacccctggaagacgggacccaaaaagccagcttcaactgacaagaagtcagtaagtatctactgttgactggggggttaaaaacgatccacagtccaagggcttaacccatgaccctaaagaagggcattgtgccacactggaacagtggccctctagctacaagaggtcagagaagagggattcggtaacacctttgcaggcctacacatagctggcttacttttaaaacctccagcaaggccatcttcccttgtttggtcatttttcatttttcctgagaaatgaagccatcccaagaatcctatgtgcaattctagtatgttctacaacaagagaatacctggcatgtgaatttggcttttatctttgaagtgtgctcctcttaaataaccataaagtgacacctgccggtcacatttgatgtttgtttggatatcctccgggtttgtcaaatcttccatcctagaaaaataaactcaatcatacagcagaaacgaatgccaaagttcctatacctcctttcatgtgtcaatgactcatcacactcttgtccactaagcacatcacttaggaactagaaaatgcagaaataaggaagcaccgttcaccatccagcagaggaaaaggggcaggcacacaactgtgtctctaggctgaaagtgacattcattccataagacaccagatgggagacgacgtctacctggggtcagggaagagtgaagaacatatgcagaaaatccgtttctggaagagggtgagcctgtgctctgggatttgtactgtggcttggattctggcaggtggaaaaggggtattccaggctgagaaaatcacagcacaaagaagagcacaaaggaaggaaactgaaggcacgcacgaaggactccagcacccgggcacgaaggcagcatcactgaaaaccgaggctgaacgtaggatggggccacatcctgtagccttaaatgcttccaagtcctcccattttcctaaacatctcataattaatttactcccaaaggcacagcatctttgagcaatgatataagtagacattttccatcaactgcacttctacccccactattcaaataggcacaaaataaatcctatcactgttctttttctagcctttttagctttgaaatacatggcccaggaagaaaaagtttacaatcactttttacctgtctgccaggatataagggtgaaaagtttgccatgagaggcctaaacttcataactgtaataaaatggcccagattgtggatttcttggttttgatattctccatgcaccattccagaaaggtagaacagtttggcaacctaaacattaaaggaaaattaaaaattaaatttcaattaaattctcgtcaatactgcaacaaaataaaagctctaaacaagaagcaatcctaagaagggagacttccagcaaagccactgtcctgaggcttccagagccttgctggattctttcaggacttattagaaccacacagaggcagactgctctgcaaccaagccggtgcatctgtctaagtatggtgaggagagggaggtgaggcctctgagcacagaaacggttctgtggccgatggaccacagcagtatggaaaggaaggggcagtgcctggtcctgtaactgggagaaacttctgatgtactctattaagtcccgactccaaaacacccagacattgcctggtgcagcaggtacggagacaaatgagatacaccaagaggcccagaataaccactctcttgagggacaccttccagagactgggaacacatacacaaagggaattcaggaggcaattcctagagagatgtttagtaatgtctcttcagtctttttgtttgtttgtttgtttgtttgtttgtttgagatggagtctcactctgtcacccaggctggagtgcagtggtgcactctcagctcactccaccctctgcctcccagctttgagcaattctcacgtctcagcctccctagtagctgggattacaggtgcatgccaccacacccgactaatttttgccttttgagtagagacagggtttggccatattgccctgagctcgaaactcctggcctcaagtgatccacctgactctgcctcccaaagtgctgggattacaggcatgagccactgtgcctggcctctttagtctggttttaaaggattatactgttagtgtctaacaattatttctcttcctacctggtaaacttctgtccagaacctgtgttttaatcgcttctttgtcttcttcagttgcttgttatgcttgaaggagtcgaggtgggtgagaactcccagaattttaggaaagccatgtgcttgacagatgtttagaaactcaaacatttccatttcaaacccaaagctggcatctataagcatcagtacctacaagcacaacacattatttctcgaagaaactaccaaaacagaccacctacactaggggttggcaactggcccacgggccaaatccagcccatcacctgtgtttgtaactaaagttttattggaacatagccacattaattcctttacatattgtctatggccgcctgtgcactacaactgcagagctaagtagctgcagaagatatgatccacaaagctgaaaatattcactatctggccctcgacagaaaagtcccactccagactaaatcaaatgactacacaggcatcacccagacagagaaaccaccaccctctgacttgctctaaaaggcaaccataagacaaggccactaggatataaacatccattttaagaattctaatgcatgagaagtaactcagaaaaggctgggtctaacctggcccttacctaagaaatcctaatttaaagaaatgaagttttctgtaatgtatttttaagccaaataacaggtctctgacatccaaagaatgggaagaaagtgataatcaatgaaatatattaaatacgtacagaaaaccaacctcttctttcaatctcctcacagaaaaaaaaaaaaaatctttttttgctgggaagtatacaatggaaacctctaacttgtatgttaatttgtataactcaattgctcagaaatatttgaaatagctaccagtttagaattaagtaaaaaaacagaaagattatgatgaatggtagtctataagaaaatataagcagataagaccaatttttttttttttttttttttttgagacagagtctcgctctgttgcccaggctggagtgcagtggcttgatctcggctcagcgcaagctccgccccccggattcatgccattcttctgcctcagcctcctgagtagctgggactacaggcacccaccaccacacccggctagttttttttgtatttttttagtagagacggggtttcacagtgttcaccaggatggtctcgatctcctgaccccgtgatctgcctgccttggcctccgaagtgctgggattacaggcgtgagccaccgcacctggccaagaccaatttttaaaatttaagacacttcaaagatgcaaaataatttcagaactgattcctggaaacttgtaattttaatactaaagatagttctgtttctatctttccatggataactaaaaataacacaaaatggaaacagaaatgcccatccttgattaaactaggaaacattcaaaacccaaaaccacagaatatatgaagttgggcttgtaggaaagcacagctgccactgcagaccaaggcagcaagcagagctctccagcaacactggaccagctcaaagaacaggtggaatatcctcacaccacatctgatgccagagtgccaagggacaagcagctggttgtagggtcaggaataaaagggagcaaacagtccctcagctgccaatctttgccatctaagccagtgtcactcccctaatccacacacgcacgtacacacccaaatccacgtactgtgtgtgcctctgctgtactcaggaggctttgacaacccagagcagagcaatcaacataagctagactaaataaattatggtgcatccacagaatggaatgttatattaaaaagaaggaggcagagctacagtacttactgattatacaccttcaagatatattacatgaaaaaagcaaagcatagaacagtgtataaaataagctaccgtttgtgtttttaaagggtggcatgtgtgtttatatgtatctggaaggatatacatatacatatacatatatataaaggtctgcagggacctgagagaccagaggttacagcaaggaaagagaaaatgcgcattgtgtgtaccgtgcattacagttagagtgctttaccaaatgtgtgtgctccttttgaaaatcttaagatttacataggcatctctctcaatgatggttaagaggctgggaaggggagcagggagggagggacaaagagggaaaggttaacaggtacaaaaacacagttagatagaataaattctagtgtccaacagcacaatagggtgactataatttattatataattcagaataactaaaagaatgaaattaaaatgttcctaacacaaataaatgataaatgtttgaagtgacggatctctgaattaccctgatttgatcatcacacattgtatgcttctatcaaaatactacatgtaccccataaatatgtacaactattatgtatccataataactaaaactaaaaaaatgtaaatgcatctcttaatatgtatgtgtttaaaattagaaacttgctacattttaaataaaagagaaacaaatgacttctatgaactattcaatcatttcaagtatacaagtttagtaatctttacacaactttacattaattacacttatttttactaatagtagcattacatgttcaaaatttgaatgttatttagttttctgacattacaatggcacaactttaaaatctgtattactttttcctttatattttaggagtcttcctaggccaaagtataaaatctgtagctctagcaaaaactaaataaaaatgaaaaaaacaaggtatctgtcaccctacacctcctaatcaatatggcttatttttttgctaatttttttttttttttgagacagaatttcactcttgttgcccaggctagagtgcaatggcacgatctcgcctcaccgcaacctccatctcctgggttgaagcgattctcctgcctcagcctcctaagtaactgggattacaggcatgcaccacctcacccgtctaattttgtatttttagtagagacggggtttctgcatgttggtcaggctggtctcgaactcccgacctcaggtgattcacccacttcggtctcccaaagtgctgggattacaggcatgagccactgtgtctggcctttttttctttttttcttttttttgctaatgtaaaagatcatagaatatcagagatagtgaacattatcatttccataaatgtacattttccacacgctgagtactatctaaattttctattgataaactctgaccacttcttcaggcaattcatgtacttactttagcattatcattaaggatgaaggttctagaaccatcaggaacaagggtcccatcttcacacaagttacttaactgctgggaggctctatttcatcttatgtaaactatagataatacctactcacctcaagggtgtatcaagggtttatgtaagctaaatttgtagaaagcagttagcacagtgccaggaaggatccaagaagaaatggtacttactatgatatatttgtacatatatatgtatgaatgttaatgagctcttattagctgtgttcattaaaggttttctccatcctgtgatttgcttttagattttggaacacatttcattgtgcacattccatttgtattattaatatgacaacatttattactaatattattatcatcatcaattcaatcacatctactatatccctgataatgaccatgatccttttaataatcacaaaactctcttcccttcatcacggggtaaataacctaccacaatgctgtaagtctccatcagcaccccaggctgcccctgctcacttaccagatctgctactttagccagatcaatcatcatgttaatgtcacacccacattcaataatggtgagtctgcgctttttacctataagtgaaaagatgaaaattttactttaaaaagaccctgaaaaaactctaaccatcaactcttaattttcattttttaattgcatccagtaaaacaccacatacgtttacaggagtgtaccagaagttcatttttataggcaaaaactggtaaaataaattccatcctgtttttcttcctgtgttctaaatttagataatatcaaaagcctacccagatgaataaaagtgctcaaaacagggaaaattctgactagacaggctccacgataaccatgatcttgctgttcagctgcaggccaatgtcttcacctctatcaaaatttcctgtattcccactatcgctaaaaacatcctcaaacataatgcaacagaatatttacaatgataattatttctaaattaaggtaataagaaaatgatcaagaaaatattggctgggcacagtggctcatgcctgtagtcctggcaccttgggagaccagggcaggtggatcccttgagcccaggagttttgagatcagcctgggccacatggggaaatcccatctctacaaaaacataaaaattaaaaaaaaggaaaaaaaagaaaaattagccaggcatggtggcatacactactcaggaggctaaggtaggaggattgcttgagcctgggaggttgaggctgcagtgagctgtaatcacaccactgcattccagcctgtgccacagagcaagactctgtctcaaaaaaaggaaaataaaatatggatgcgccaaagataaagaaaagcctcaatccaactatattactgcaataataagagatttcagagtgtacattgccattctaccactggacgtttgtttcatcttccctcaaacttggaaaggtcaccatctcccaaagcagacaaattctcataggaaaaagagaaaacgcgcacttccaccagcatgtggcttcataagggcaagcatgtgcacctggcacataggaggtacgtgctgtctgttaaatggtgtgttcgcagtgaccaggcctgtcaggcccttccaaggaacatgcttggcaaagccatagagcagtcaggataaggtatgtatcacatccttatctctgggaacttatccttttatgaagttatagctaacttagtaaaagtaagagagaggtaacatgatatgacaatatttaacatgttccactcaagaaaacaacaaacacacgcatgtccctcagatgacaacagccacgccaagtctgtgtctgtggcaccatctcctacctgacacgatcgtcacagggcctctgatctcggtgaacttctgccaggtgaagttccgaatgaggcattatatcaaagtgctctttccaactttggaggccccgtcaccactaccggtattggtggcggctctagtggagttccatcaaccactggaatatgatgcttttgtgtcttcaaatccagagtcctatttatttaaaaaagaaaaaaaaagtaaactcacttttaaaatagagtaaaaggtatcaaccttataagtagacttttttttagtataattacagatatgagtactttagtatattttatagagagtacaacagacaatataaaaatataagtaacttgtcaattattaacttctgacccctatccaaatcaattgctgttcaataaagatgtaacaagatgacttcaatagtatagagttgaaaattaaacacaccttaaatctgactgctttatgagtgatttttatagttttttaaaaaccaaaaggtaaatactgaggcagtgcatcataacagataagagcagaggctctggagttaaatttggctctccgacttactggttgtatgattggaggtaacttgttttcttgacctcagttttcttgtccataaaatgagggcaagaatgattcctactctggtaaggctgctggaaggatttagttgaataacgtttaaagtacactgctaagaatatcataaggactcactaaataaagctatgttagtattacatattgtaatttttgtattttatattacaactttgtaaaacatatccagagggaaaaagcacacttatcaccatagaaacagtttaaagtttaggaagaatcaaattctataaattcttgtatcttgggcaagaaacgccaaccagtgtgcagatgctggaggcaaggcagcttctatggcaagtcttctcacgttttagtaaaagccacacagcatgcatctccatgtcctttggagctggactagacttgtgaatccaaatgtcacctgtgagaggctcctaactatttaaaaagattcaatggaagaaccatcagactgtagctaaacacacctgtgaaaggatcgagacatccacacagcagactgaactgcaaaagcattggcatttctcttctgggcattttcttagtctcctagctggagatcctgcagatgccacttctttttctttgcagctttgggtccaccgtttttctttctgtgtttcttctggtccttagtctccatagtggctatttaccaataacaagtaactctaacctacaaggaagaaggttggggtaaggaggtgggagaagcattttacaatccaggcaatacccagggaaaaacattaaatttcatttatttctttatgaagacatgatgtatttgttcactgaacaagggtagaaactgcttaaccatccccaatttcatttctctctgttatgctataaattagatgagttacctctgctaaggttacattctatggttaagttactttttattcatctcaagtgtcaacatcaccagtacctatttctgcaaggatggaaatattctatatctgtacttttcagccatttagccattagccacatgtggttacttaaaatgtacttcagagaaactgaaaaaatgaattcttaattaatttcattctaactctaaatagtcacatgtggctaccatactggacagctcagacctagacatcgactggactaacgaagtggtttcctaacttaaaccagaacttaaatttcaataaaaaatttaaaacgtttttatgaacttccaataggatcgcagtattacttttagtacctgttgactctaaaacttctaaattacagctcatctacatacatttgaaaaatagcaatatctgtatgtgtgagatatgactggttttagatgatgcctggagaccccatggacttacagagacccttccagtgatttctgaggtacctgggaatctgtggccaataaattggtagtcactgaatctgtgagtttttttggaatatcgggctgcataaaatctgacagcttgattgagaaaaagcggggcagggtaccatttcattcagttaaggtcctgtattcattccgtttaataaatgtttgtgtctgtctatgatgtgctagccactgtgccagaaaatggatatagctatggtctgattggcagaggaaatccaaactagtatcttccgtgccatgcaataagggctacattgcaaggctgcagagggtgctactggagcacagaagtgagtcagaggcttctcacagacacacacacgagcggaaacagaaagtctttatatatcaccatatgtcaaggaacactggccgggagttaggagagctgggcactaggaacgctttgaaactgaatagctgtgtgatttcagaggttatattgcttctctactatattttactgccgaacttgtactgtttctctcccttttcttcttggtgggaaaagcacaatttggggtcaacagattcggctcaggtctaagtcgcctgccgggaccacgtcgccaggaaacgacgtctccccgacaccttccctcccagtccgggctctctgcagggattcatcccgtcactctcccaacgacccccgggcacacctcaggcagatgcgaaatatgccgctcctcgggagcaaagatgacccggaggaccgggggaggaccttcccatgcgcacgactcgcgatcttcccagtgccccagagccacggacccaaccgccgcctaccccagcccgcggcaccaaacctgttcacaactgcgactccttaggtccgcttggacaccgccggaaacggaaattcaccctcgcgccgactcgccggagggaaacaaaaaggcagaaaaaaagggaccgccgcctggatgactttcaggggacagctggaagaaagactcgtcaacggccgagtgctggcgccggcgccgtctgcgcagtgcgttccaccgggtccgcgtccctcccgattcagccccaccccgccctcggaatccgctgcctcagctcctgctgtggcactccccagcagcttgcacctcgctcgcggagtccttgctgaaggccagggcagctgtgcggcctggcgcgggttacttgatgccgtgcaaaagccaggagacacatttggttctggccgccccggagtcaccgtgcccggggcgaatggactatggctggattgggagtccacttcctcctctgtaaagatgacagacgagggagatctcgcgttctgggggtgccctatagccctcttttggccagaagcggtggatcacgcctgtaatcccagccttttgggaggccgaggcaggaggattgcttgagcccaggagttcaagaccaatctgggcaacatagggaggctacatctctcaaaaaataaataaataaataaataaataaataaataaataaataaataaataaataaaaataaagccagcgtcgtggcagggcgcctgtggtccctgtggtcccagctactctggaggctgaggcgggacgatcgcttgagcctgggaggcagaagttgtagtgagctgagatcgagccactgcactccagcctgggcgacagagcaagacactgtctcaaagaaaaataaataaataaaataaggccctctttttccgggaccaacagactctgagggcagggacaaactgacccagcctaaactgcctcgccttccctgctcccgggaaaggggctttccctgagggaaggtagcatcttgccattttcttcctgcacagctttgccttcccagggatccacccattgccacctgaggaaatgccttggagcccatctaatccccagcccagctacttgggacgcctacagagactacattgtcagaggatgcatcttcctctagtcttggagggtttcttttcaatatgatcccaccggtgcatgcaaggctcaattctacatcaaaaaactaggcccactcctgtcaccgagacccccaggcttcaggtcctgtcacagtgaccttgttatcacccccagcagcccccaggtattcactctgcataggctatatactgggtgctgcactagggaggctacctacgtggcgcatgcttcccttatccctgaagagcttaggatgttgtaacttcttcacactaggcctcttacttcttggagatgtcagtagccgggtaaataatctttctaacatccttttggtctcatgaagcccattcttgtcctctgccctacctcagcttccccctccctccatgatcagaccttagaccttgtcaggtccaaggactgcaaccctcacagtatcccactctgaccaccacctcctatctagagcaatggagagactttgtaggtgaaagctgtctttgctactggttctcctatgctccctcgcctggctcctgcaggcggttgacttcaccagggacacagtggccagtgcccagcaggtcccactcctctcaccagctccaggcagttttattatagagtaactcttctgagacaccgctcctttccccagcacctaaggaagtatttctagtaagttccagtggtatagcatcggtgactctcctgacaagcagagggccatggctgggttcctctgatgaggtgcaggggcagggcactaagaggggaggactctcctgagttctctacctgagccctagactagtagctgctcctcctatacttcctactagtctgtgcctggttactccacttccctgttgcaattaacaattccctaggtacacttttcctgttcaaatgactgtgtggcttctctttcctaatcggactctgaccaatacgctatcatttgccaacaactcccaaagttttatcagtgactcagacctctaacctgaactccagctgcctccatgacatatccatttggatgtttaatggacatttccaaagtgatatgccctacagaactcagaatcttccctctcaaaccaactgctcagcagtcttatgatcttagttgatggcaattcagaagtgaattgcaggacacccggtttgtatctgcagagagaactggagaactgcttagtgtggaaaacccacacatttggtttcagaagtgtgtgagtagaaacagttttccttttatgtttgttggatggataatgatgaacctagcaggacacagaaagctaggcagcagtggaactgagaatgaagttatacttaatagcagagaatgaaaaagaaaagacagataaaacattttgaagaaaggacagtaatgtattcccaacaggtaggatttacaggatggagagaagaggcaaagataactacaaaatttctagcctgagagactggtagaaaaaaaatggtggtatcagggacagacaggggttattaagaaaaaggattggatttttaaaataaagaagatctggtgtaaaattatcctcaggaaaactggaaaactaggcatgtacttctctccatcatgcccttgcacagtgcagtccttctgcctgtccatgcctcgcctccccctccctaggattcctcttcctctcttaagacccatctcaaatatcacctagacttgtaagtaatttacatgaaactggatacctgaggtttcaagcctttatccctttgaaagtttttaataacaagttactgttatcttttactaagtccaagtttatattcgccattttaactagcatcatttccgtttccaagaggtatttggtgtgaaagtgcaactaagtttactgttaatcaagatcagaataaaagaatctaccaaaaaaattaacaagatcccccttttaatgcataatcttccatccatcaggctgtaagttaaatacctaacataaaagaaagctgtatgttttatggatatgtacatatataactgcagggaatatgatttggaaggatatacacttagagaagactggggtcacaagtggtagtcaagggagtcttcagctttctttttgtatttcaattttgacagaaatacatacatatgtattataattttaaatttttaatgaaaaaaagtatttttccttttttttcttgatctgtcactacattatatttttccaatatcagctaaacatttgcttcccagaaagcttagttgtcttttcaaaatttattcaggttaaaataaaagatttagacaatgaattaaaaatctaagatggtatttgcctactttatacagaacagtacattgatgctgctaaagcaattaaagtataatttttattttctttctttttttttttttttttttttgagatggagtctcactctgtcacccaggctgaagtgcagtggtgcaatctcagctcattgcaacctctgtctcctgggttcaagcaattctcctgcctcagcctccccagtagctgggattacaggcgtgcaccaccacgcccagctaatttttttgtatgtttagtagagacagggtttcaccatgttggccaggctggtctcgaactcctgacctcaaatgatctgcccgcctcagcctcccaaagtgctgggattacaggcatgagccaccacacccagcctaaagtgtgtactttttcttagctcctatatgcagtgctccttccccatgctgaatgtctgaatttttatctgagacatagtatttcagatggtcattacttacgggtggtcattaatagttcctccctgcttctaaccttcctctcctcattttaaattaagttacgctacattattgtggattagaaagtacattaatattaagtgaaaaaatatgatctgatgagtaagtggcaagagtgttaacgtatgaatattaagagttgttctgaggcctttttgcttttctgggggttctgtgcttgtggtagaactcttggttattttataaatagttgctgaaaagtgagagagtacagctggaaatcagatttctgatgaataaatcaaaccctattaagagaaccaggttgaagtaattttaaaaccatttggattttcataaatgttttgttaatgattaattataaaaaaaaaacagtgactctagctggaggcttttgtgtgtttgcttttgagtcagctaggaaaaggaagaaaaattcaagcttagtcaattgtggttttcactgaatcttttttaaagtaatgagctggtttgttttcttcatcactgtagcaacttaagctagtttctgcttttgatttttatttctcctagagaaacttagcatgcactgctcattagacttgagcatactaaggaatatctgtggtaattaagttaaaaatcagatcagtgctttgtgctgtgtatagttgcagatgtctgcatttcactaatattctttggaaacatctggataccagttaacataaaataactgtttagttggtttctgttcagaatagaaggaatgatttaaaagttcccattgtagtacatacgtcattctgtccctagcccttcctccagctttactgagatagataaataataaacgtcatgggtggtgtgtcttcagtttcctctggtgagctggatgcacagattactttgtcagcagggtggccttgatttttaggccatgtgtctaatggcatcagctctgtggccgacacctgtgtaccgagcccattcactatctagcttagccagccgtggactcctgctctttgttaaaagtatttaccttcattcctactagcacagttgaccaaagactcagttgatcccagacactagtaatgcatcaatggagtctaacagggttttaagatgtgtgtgtgtgtgtgtgtgtgtgtgtgtgtgtgtgtagaaatgggatctcactattgttgtccaggctggtcttgcacacctgagctcaagttctcctgcctcagcctcccaatgtgctaggactacaggcatgagccaccatgcctaaccctctaagactttgggatacaaaaatataatttactttcctccatttctggaataaaacatctcttccttcctccccctagtttctgttctgtgcccctgtttgatctctgttggtcctgttcaccttcagccttctctgctgaaggaggaaaggcttggttttataaaaagtgacaatattcagaccacataagatccttcttgcttcattttggattaaatattttaagattttctgattttcttgtatgcatatgtatttacctattatttgactttattgaataacttcaaattgagtatatttgaatgggaatgggcattaaaaagggctaagctttccctgcctttcagaactttgtatgtatatgtcacatcattttgtccttcacattctccagttgtgctattttttcccaatccattaagtagagtaacttcctttttggagtcttactttttttttttttttttttttttttttgaggcggagtctcaaaccgtcgcccaggctggaatgcagtagtgcaatctcagctcactgtaaccaccgccttagcctcatgagtagctaggaaatacagaagcatgccaccacacccagctaatttttgtattcttagtaaagatgggggtttcaccatgttggccaagctggtctcgaactcctgacctcaagtgatctgcccagctcggcctcccaaagtgctgggattataggcgtgagccaccacatccagcctccttacttaaatctcttaatgtgccttagaatgtagttaagaattttcaggtgacagtatatttttgatagttatctttggtttccaaacccagagaaggaagagtaactggctttttctgtttgtgggtacattgtgtcttattggagattgttttgtctcaagtattgccgcagagtattttattaatgggtgcactttaaaattttttgtttttcagattaacagtttaggtagcccagtactcggtatttgccaatttctagaattaaaaacgtgtgtatcactggttaactagaaatttaaaatgaaaatgtgtcttctttagcccaggcaatatcacttgcattcacttctatcccctccttgtccctactctgttggctccagggcttcttccactaagctggtactttctttatagctcctcctgtacttccattcactgaacctttattggttcatagcctacagaaaatgcctgtggtgtgagaggtaatttgtgaaactgcttctcttcactgtttagcaggttgagctctctaaatgggtgtagctgggaaagaaaatttaactttacaaacaagaattcctgggttccatccagcggaacatgtctcttgttatacacacacagtttctgacccatatcattccatgacttatgataaaatggacattctgtttacactgttgtgtggaaggagaggtctggttcctaatttttagtaacatctatttctagaatattaggcttgccatttgaatgcttctgtttgatttatgaatatcattggttccagcagtttttagctccctgctaaatgcaagttaaaatttttaagtttctaagttaaaagaaaataacttttcctccacttaagaaagccaggaaaattaaaaataatgtagtgatgacttccacaggctctaaaagagcaatgaaaaaagtgatttatgtgtgggagaagaaatactagttcttaattaatacattgttttaccacttcccgtgaatttatgtagaagtaatgaaaccaaggtttaagtcatttgttcaaactcctgtcagtttagactttttaattgctttgttacatgccattgctttgtaatacttgttatagcagtggtaacagttgagatttgcctgtttgaccacttgcagggcaccgtgccagattccccatgtgcgatgttcctcgcagttgtgacgcccatcctaggagggtggcgttagcacccctccatgcaagcggatggtgcaggctgggtcacctgggcacagcgcctgactattttcctggcttagtgtagttatcattaaatatgtggtattacttagaagcattttgaataatttgaaaagcacattttagtgttaaaacaatttttttttttgagaaaaggtctggctctgttgctggggtggagtgcagtgacctgagcgtagctcactgcagcctgcaactcctgggctcaagcgattctcctgccccagcctcctgagcatctgggactacgggcacatgcccccacacccaactcaattttttttaagatacaaaggattcatcttaatattatttacaatttttttttccttttctgtgggcctcatctgactggaaagcctttcaatttttttattttttaaattgtaaattgacaaattgtagatatatatttatgaggtacaaagtaattttatgatttatgaatacaacattacataattaagtcaagctgattaacctgttcactactggaaacaattgcaaataattatcattttttctggtgagaacatctgaaatttactcagtgattttgaaatgtgcagtactttttgttgttgttgtagaaatgaggtctcactatgttggccaggctggtttcaaactcctgagctcaagtgatcctcccacctcagccttccagtgttgggattacaagcgtgaactaccatgttgggccaaatgtgtaatctattattatttactgtattcaccatgctgtgcaatttatctcaaagaaacttattcctcctgtctaattgaggctttgtgccctttgaccatcatctccccatcacccccatccccaatgttgtatactgagtcctttcatgatatgtatggaggcttatggtaagttatttaaaagtacatgtatgtcaaaattttttgtggccatagcttttctttcttttttaaattttaagagtcagaatattcgtatattaattcagcatgtatttgagtgcctaatgtatgccattttctatgttaggaaccaggaattaaagcagtgaacataacaaagtctgccctcgtggtgctaacttgccaggtagggaagccagatactaaacacatgtataatgcaaagtcagtaataataaacgatatgaagaaacaagtaaggtaggagaggcaggaaagtgggagtgagaaagaggtgctcttttaaatacagtggtcagggagagcctctcagaatgaagtttttaacagagacctgaatgagatgggggagtcagctatacagatatctgctgtgtgctagaaaaattacctgtaattttgcattctaaaagtttaatgagtacatttatttcacaatttgagaatcaattatgtataagatatagttgtaagcacatactcctctaaatatgatttgtttttacagtagaccaaataagtatgttcagcttagaatatgctctttatgatctgtataataaatacattctcttaaaatattgttaatattaaggttgatgttttcagaaacatataaaaaagctagcttttaaaattgactagggaagttctctcaaactgccagtccctgagatattgtatattttctatctgaaaaacttttattctcagaattctttaaaagagctgtccctgaggctcccattacttacctgtgactcccagtggaaatcgtacccagcccctcgagaggggctgaatctgttgagagtgggagggtagaaaaaatgctgcagcttcttgtgggtaaacttcacacacaaacacccagtgtcccaagcactgtgcagtcaaacatcaaccctgctcagactttcctccttgggattgagaagcaatggattatagagaaagaaaggtggcttagcactccaaaacttggaagggtaattgaccaagaccccccaaagccaaagcagtgggcatccccactttctgtataccctataccaacacgtaatggctactagatacaggggcactagtacctgtctgcttggctacctccccttcttgcagaagtggtgaagggaatcactcaacctcaggaagggaaaatggctttctcatcttcaaattgaaagaggttggcagtgggtgaggagaataacaggtaaggatctctttcaatatacccatttgaagccaaaacctcagtttagacatacggtattttgaacctggtgactattcattgcccatgtttgtgaattatcagaaagcagaattcttgccaggcatagcggctcatccctgtaatcccagcactttgggaagccaaggtgggaggatcacttgagcccaggagtttgagaccagcctgggcaacatggtgagatcttgactctacaaaaaattcaaacattagctgggcatggtggcatgcacttgtggtcccagctactcaggaggctgaggtgggaggattacctgagcccaggaggttgaagctacagtaagcagtgtctgtgccactacgctcagcctgagcaacagagcaagaccctgtttcccacccctacccaccccctaaaaaagcaagctgaattcttgaactccctgcaaccaggtcacgcaaaccaaaggtaaaaggaacataaaaaagccttctggaaagtgtacagaaattcattgcagggtgatttttgtcttgtgaaatcatagttactgttattagcagctttttaaaatgttttatattcattttttatggtgttctgatgtatgagctgcttcaagtgcttttggacatagcttgggtataaaatgtaaaaagtggatattttcaatttgtagctttcttttttgaaacttattgaaatttgttctaaatataaccccttctttctcacccaccccaacacattttttaaaaaacaccaccaggtatccgttatagcactgatgtgagtgtagatgaagtaaaagctttggcttctctgatgacatacaagtgtgcagtggttggtaggtgatcgcttttcttgctacctaatgagaactctggggaaatatgtttacaaacatgttactgttaagatgctatagaaatataccttatcggaactgatttttttttaagttgtactctttaagacctgcatcatttctcaattactctaaattaagatatagcctttttttacgggagggatttttttacgggagggagctaattggattttaagtctagatctttgttttcaattcctcaacatattctataaataagaccaaattatagtagaaggagagtaaataagctattatctttttaaagtggtgaagagcactgattaaatatatattagagccccagcccccgccccagctgcgcgggcccccgcctggcccatggactgcacagccgagcgggcgccttgagcgcggtgcgggtcctcggagcacccccgaggtgagcgcaagcaaggtccggcatcatgtgctaggttattcccagtgcgaggccacacttgggccgtcggagcagcccctcctcacttcaggggtcaccctccccaagacccattgccccatcatggccggggaccggctccccaggaaggtgatggacgccaagaagctggccagcctgctgcggggcgggcctgggggggcctggtcatcgacagtcactccttcctggagtacaacagctggcatgtgctcagctccgtcaacatctgctgctccaagctggtgaagtggcggttgcagaagggcaaggtgaccattgtggagttcatccagccggccgcacgcagccaggtggaggccactgagccacaggacgtggtggtctatgaccagagcacgcggccgcagacagcttcctctccatcctgctgagcaagctggatggctgcttccacagcgtggccggctgcttccacagcatggccatcatcacggggggcttcgccaccttctcctcctgcttccccgacctctgcgagggcgagcctgctgccctgctacccatgagcctctcccagtcctgcctgctcgtgcccagcgtgggcctgaccctcatcctgcctcacctctacctgggctcgcaggaagacgtcctgaacaaggatctgatgacgcagaatggaataagctacgtcctctatgccagcaactcctgccccaagcctgacttcatctaccagagccacttcttgcgggtccccatcaacgacaactactgtgaaaagctgctgccctggctggacaagtccatcgagttcgtcgataaagccaagctgtccagctgccaagtcatcgtccaccgtctggccggcatctcctgctgtgccactatcgccatcgcctacatcatgaagaccatgggcatgtcctccgaagacgcctacaggtttgtgaaggaccagcgcccgtccatctcgcccaacttcaacttcctgggccagctgctggaggaccagagcagcccgaagctgctggccgccgtgcagggcgacgcgggcaccccctcaggaatgcaggagcctccccccagccctgcggccggggccccactgccatggctgccaccacctacctcagagaccgctgccaccaggagtgcggctgccagggagggcggcccgagcgcgggcaggaagcccccggcgccccccacggccaccagcacgctgcagcagggcctgcgcagcctgcgcctctcctcggaccacctgcaggacaccagccgcctcaagccctccttctctctggacatcaagtcggcctacgcccccagcaggcggcccggcggcccgggcccagcgaccccggcgaggccccgaagctctctgaaagctggacagccagtcggggccatgttgggcctgccctcgccctgcccggacgccgcgcccaggcacgcccacggcccggcgcgctaccccgcgcgcggcctgaacttcggctacgcggctgccgggccctggccagccggccagccccggagcctggacgccaccgctcgactccctgaagcgtcctcggtgcttcagccccgagggcgtgcaagggccgggcagggtgctgtttgcgcccttcggccgggcgggcgccccggaacccaacggctgcagcgacctgccacggcgggaggcagcaagggctgagcccgggacgcgcggaccagctggtcagacgagctggccccggattcgcacttcaagtgctgcagctgccagatggagttcgaggagggcatggtggaggggcgcgcgcgcggcgaggagctggccgccctgggcaagcaggggagcttctcgggcagcgtggaggtcatcgagatgtcctgacccctccgctgccctcggctccgccgcccgcagctgggcagttataaatatatattatatataatgcaaagaaaggcaaatggttttactgcgatttttatccagaagtaaatatttcgattttttatttatttaagctgttcattctggcactgatttggcaacagtgcgggtggtcctcgagctctatttttactgtctggtatttaaaccgaaacacacgtttctaagcaataagaggccaccttcagtcgcaagttgcaggccaggcctggggcccctccctgatcccccgccccaggaaacactgctgacatttgcagaggctgccgagctttcgtgaactttttacacaagagaaagttgaaaaaaaaaaaaaactttcttgccacaaactgagccgcagaaacccccttcttcccccacccaccgcccctgctctctcccttcgggctccgccccaaagccataggctgggggagcaggacctggtgtgccccagagaggtgcggccagccctccaccagctctaggcaccaaatcttggtggcagggagggcaccccgctgcccgttgccccagagctgttccctctcaggggaggacatgcattgggccccatggtgccagggcgttgagaggggctgaggaatagaacagtgtgtgtaggggcttggggcagggggttctggagggtcagatgaggcagagcccaggggaggatgggggtgttattaatgccccaactcctgccagagccccagtccagccactgagtgcctcagaaaggccattcccagagggctgcggccctcccttctcctttgcccctgcccccagagctacctgactggcagggcggcactactgcaggagaggagcttggcctccgggggtcaggcaggaggggggcctggctagcctgtgctggctccactgggcggggagccctggactgccaggtatgaggagggggtgggcttagggtcctgttccaggtccgtcccccacctagcaaggccccaggcaggacttggaaaccaggtgtgcacctgcaggctgaggggctccatgagcaggtgctgccttgcacagggagttcaggcgccagccaagcccctgtgcttctggggtaggcctgcttcacttagggagcgctgcctcaaggcagataaagcccccttgttgacccgacctgcatgggggcctctcaggagagaaactctcgtgcgcccctttcccagggcgccctctttctagacagcattccagcccccaaacacaggtggcttttgggcccagatgggtcagcctgctgctcctggcccataccctctcaggccgttgggactcctgcccttcagatgtcctagggtctaggagtgggccagtcaccctgggaagaggccaggggcttggcaggaggggcggcccaggcgggacccagtcctgagtcctggagcagggccagggaggcgcccgccccaccccagccagccgccttctctgctgtttcttctatttgttcttcttttcacccacagccctgtgttcctgtcatccctcctttcagcaaaagtcctgttcccgttccctctgtccccacccactcttgttccccaagaaaataagctatcattgttgcatttgcaatctatggattagaggtttaagtatttattattattggttaattattattatgttttatatatatatattagaacttggctagccaattttattgaacaattcctgttcaataaatgttgtttaaagtacagttgagaaaacgatggtaggtttatttcttgaactttcagaagttcaagcttaaagcatcacacgtttttctaatatcgtgtggcgctttctgtcattttacttttttaacctttatatggaatagcaaccatcaaccttctctttcagatgtgccgtttgggggtgctaaagctggtgttaagatctatcccaagaactataccgtaagtatgaaagtttttgtttttgtttttgtttttgcttttttgacacagagtcttgctctgtcgcccaggctggagtgcaacggtgcgatctcggctcactgcaacctccgcctcctgggttcaggcgattctccttgatccagtaactgggattacaggtgcatgccaccatgcctgactaatttttgtatttttagtagagaggggatttcaccatgttggccaggctggtcttgaactactgaccgcaggtgatctgcccaccttggcctcccagagtgctgggattacaggcatgagccaccgcacccggcctcaaagtgatatttgtgcacacagtgcatttatgaaggacttgaaattactgggcttctctgtatcccccatatcagtgaaatcaatagtccccattgcttttcaaatggaatgaaaaaagtaaagaattaactcattgagtgttttgccatataaaggtcacctacttaatatctatatcctttatcattttctgttttgtttggttttgtttttatgagtcttttttttttttttttttgctttttgtattattattttcttatttaaaaggtaattaatatcttcatattattagacacctatacccatatttaagaagtactgtgatctggctgggtgcggtggctcacgcctgtaatcccagcactttgggaggccaaggcaggcggatcacgaggtcaggagatcgagaccatcctggttaacacagtgaaaccccgtctctactaaaaatacgaaaaattagtccggcgtgttggtgggtgcctgtagtcccagctactcaggagactgaggcaggagaatggagtaaacccgggaggtggagtttgcagtgagccgagatcatgccactgcactccagcctgggtgacagagcgagactttgtctcaaaaaaaaaaaaaaaaagaatcactgtgatctaattagccaggcatagtgacgcacacctgtaatcccagctactcgggaggctcaggcatgagaactgcttgaacccaggaggcagaggttgcagtgagacgagatttcaccactgtattccagcctgggcaacagagcaagactctgtctcaaaaagaaagaagaaaagtagtactgtgatctgaagtttttaggtcaggatctcatgctagtgacaaatatcttaactaagccaataaaaaccttactttttatcctgtcagttccaagtaaattcaaactggttgtcacaatgctttacataatactaaattatctatatacaaacataaacagatatgatttttattctctttaaaattcaccatttagatggaatataattatattacagttaaccttaattaagatttggtatatttttcagtggggaattaatagaatgggaatttgagtcctggttctactatcttgtttttataacctacttttttgatcccttattttctcacctttaaaatggcattgcctaccttatgagttgttctaaggatgagaagacatgaaaatgtactataaatagaaaataagatgctagctataatctcaagcgatttttatatcttttttatttttattgttttcttattttacaggataacgaattggaaaagatcacaaggaggttcaccatggagctagcaaagaagggctttattggtatgtgtagccacatagattttggcataaagtgggaacatctaaaaaaatcttttttttttttttttttttttgttttgttttgttttgtttttgagacagagtcttactctgtctcccagactggagtgcagtggtgcaatctcctccacctcccgggttcaagcaattctcttgtctcagcctcccaagtagctgagactacaggcatgtgccaccacacccagctaattttcgtatttttagtagagatggggtttcgccatgttggtcaggctggtcttgaactcctgacctcgggtgatccacccatcccagactcccaaagagctgggattacaggcatgaaccactatgcccggcctcctactatttgtgataggagcttttgccaaacatacaacatttttgaagacactaatcttcgtttgcttgatgtcttcgtatcttactattatctgtgtttatatgttctttgtgtgtgatctgaacattcttttctatgatatgtaaatatttgtcatttaccttctaattttcaggcagtttaaacctttctatacatatatttttaatctagaaggcttctaatttgtttgaatagaatacacataattatttaataaaatgcttgccctatcagtatagttaatagaatgttaatagttaataatataatacttgccctatcagtatcagtatagttaaacaaaataaggtctacttaaataggaaataaagtgtatttttctctactttctttctcagcatttcccccaccatggacaaatgcctatgaaattaaactataaagtctgggcatggtggctggtgcttgtaatcccagcatttttggaggttttggaggctgaggtgggaggatcacttgagcccggaagttcaagaccaccctaggcaatatagcgagaccccgtctctacaaataatgaaaatgttatccaagcgtgatggtgcatggctgtggtcccaactactaagatgggaggatcccttaagcctgggaggttgaggctaccatgagctgtgatcatgccactgcactctggcctaagtgacaaaacaagaccacatctcaagaagaaagagaaaagaaataaagctattcagattcatttttaggaaaaaagtcatgaaataaatgtcatgaaataacctaatatagaaatacagtaagtataggtaactctaaaacttgactagatttggcctgtctttcataataaaaggcatttgggcctttgacgtgccgcatacccagcactactgtgaatttgtgcatcattacgaggagcctattaacatgagtgaactatctcactcacacttttataggagtacctaccgattctgagatatggtgaattgaagtcatgttcagcctgttaatagccttcataattttcaaaaggtctttcctcctcgcctaaatctcaaacacattttatagtcttgaatggtttcagactttattcagtcatatttatcgcccatatctgcaatatctccagctaaattttatcagtcttgacaagtacctaataattccaaaggtcaaaaagtgattcattggaatactgaaagaaaacacagcttaaactctagtaacttgatttatttgcctaattcgcaaaggcctcattgacccatgatgcagctaaattgacgtcttggcccagacagctttgaagcctaggaggcaggcaaagggagttttttctctcacttctcggcaaaccttcaaattcgatgctatttatctgttatttcctgacactccacagagagtgtcagattgaggctcagacctgagcctgagccctgatcctatcacatgtgtgtttagcatcagcttgtaaatttctacaaaacaaaacaaaacaaaaaaaaagaggctgggattttgataggaattgcattgaatctgcacaccaatttgtggagtattgccatcttccccaccctccccaaaagggttttgccctttcacccaggctggagtaccaggcagcagtcactgcaaccttgacctcctgggctcaagcaatcctctcacctcaccctcccaagtagctagaaccataggcgtgcgcaactgcacctggctaactttttaattttttgtagagacatggtctcatcacgtatcccagactggtctcgaactcctggaatcaagcaatcttcccacctcagcttcccaaaattctgggattatgggcatgagccactgcacctgaccagtattgccatctcaaccatattaagccttccaatgctgaatatgagatgtctttccatttatttaggtctctgatttctttcaatgatgttttgtagttctcattgtagaagtcttacaactaagtattgtattccttttaatgctattctaagtgacactgatctatcgttttcttatgatgtctttgtctagtctttgtatccagacaattctagcctcatggaatgagttgaggagtgttccttcctcttctgtttttggaaaagcttttgaaaggtcggtgttcattcccttgtgtgagtgtaaatatcacctatgtaaagttctgcaggaccctgatgtctccacccttctcatcctcttatatctctgtgcaccaaaattaccctttcatctcctactctatagtcacatgctgttagaaaagttgcttttttaaaaaagatgaacttctgcctcagaccgtgctctctatataagaatttacctgttaggccagtcgcggtagctcatgcctgtaatcctagcactttgggaggccgaggcaggcaaatcacctaaagtcaggagttcgagaccagcctggccaacatggtgaaaccccgtctccactaaaaatagaaaaaagtagccaggcgtggtggcgggcacctgtaatcccagctactcaggaggctaagggaggagaattgcttgaacctggaaggcagaggttgcagtgagctgacgtcatgccgttgtactccagcctgggcaacaagagtgaaactccgtctcaaaaaaataaaaattaaaaaaaaaagaagaacgtatctgttattcaggagctacttgtaatctgtgcatcccaatacattagttttgtatggagcagaaaactagtaagcctaataattgataccttgtgattttgttttgggtgggtgaagctgtttcatgtttaacatgtatagactgtttttgagaaggattttatcattatatgtttgtgatttacaaactgtgtgcttcagacttgccacttgccagagcccttctccaattggaattgttttttgtttttgagacagtctcactctgtcgccaggctggtgcaccgtggcgtgatctcagctcactgcaacatctgcctctgaggttcaagcaattctcctgcctcagcctcccgaatagctggcactacaggcgcgtgccatcacgcccagctaatttttgtatttttagtctacaacagggtttcaccacgttggccaggatggtctcgatctcttgacctcgttatccacccaccttggcctcccaaagtgctgagattacaggcgtgagccaccgtgcccagccagcttttttgtttttaaaatatattgtttaatcaagatgggatctcactatgttgcccaggcttgtatcaaattcctgggctcgagccatcctcctgcctcagcctcccaaagtgctgggattacaggtgtaagccactgccccagcctagttggaattgttgtttgaggtaacaagcttacttaatcctaaagcaagcataatactttcgtagatgcctctagaaagattcgggaccaatttgtcatttgtacattgggagaaaaggagtggttaaacaaagttttactgacctccagcagaggtatgtcactaaaggaatggaaagtgagcaaacaggagctggagagcaccagagagcccttttgtcagtggatgaggctagaatatggcattaatccttccaagtgctgtgtggggttagacttctcatgaaggataggtttgggtaggttagacttcatgagatttttttctgtttttaagttttttgttgtccttgttgacttcatgagatttttaaggtgactaagggaagggtgctaagacatagagttacagattaggtgggaggtggagagggttggggtataaaaagcagtccttgaacatttcaaagttgtcttataccagccctgtatccaatatatcacatcttgttcaaagaagttgattatctaggccttgggcccctgagttaaagaaaaacattacagtatactgattccgtcgactaaaaagtaaaatttataggaagaattgagtacagtccttagaaagaactttaattattttatggggggacataatggtttaatagtttaacctcttttttttttttttttttttttttgagagacagagtctcgctttgtcgcccagactggagtgcactggcgcaatctcggctcactgcaacctccgcctccagggttcaagtgattctcctgcctcagcctcccgagtagctgggattacaggcacttgctatcatgcctggttaatttttgtatttttagtagagacggggtttcaccatttggtcaggctggtctcgaactcctgaccttgtgatccactctcagcctcctaaagtgctgggattacaggtgtgagccacaacatccagcctaatagtttaaccatttttaaagttgtgtttttctttttgtaaagatgagtttctattatacagttgaaataatatagaaagttataaacaatatatatatggtggggagaaagaatggggaagagaaagaaaattgtaagtgggaacatgttatacatgttgtatgaaacctgcctttttccatatgtatgtttgtgataattccaagtaatttacatgcatatgttatcctttttaatggctgtttagtactttgcataggtataccatagttcatttaattgacatacaagataattagattgtttttatttttactatgtttgagaggagtatttctgcacctttacggatttgagtgagcatcacttaacatgtttttatcagagatcttactgtagcagtcagtagtagtgcagtcagtgatttctgctatggcctgtaagctaatttgttagcctaacacttcaatttgctatgatctgaggaactgaaagctaaggcctaaaattttatatgtgctaagtgtcgaataataggtcaaagctgcattcttccacaagtaaagataatatggggcttaacacaattgctttagcaatgtgattttctcccctttttctctacttggtaaggagggcttatacccccactaagcaggcacatgcctgtaatcccagctactgaggaggctgaggcaggagaatcgcttgaacctgagaggcagaggttgcattgagctgagattgtgccattgcactccagcctgggcaacaagagtgaaactcaaaaaaaaaaaaaaaaagaaagaaagaaagcaagcaagaaagaaagaaggaaggaaggaaagaaagagagagaaagaaagaaaagtaaatctgtggatattgtacaaaagattgttttatgattttttaatttttttaacataacttttattgacttgtatttgtatttttatcaaacatacttcatttgtttatttatttattttgagatgaaatctcactctgtcacccaggctggagtgcagtggtgggatcttggctcactgcaacccctgccttccaggttcaagcaattctcctgcctcagcctcccacgtaactgggattacaggcatgagctaccatgcccaactaatttttttattattagtagagatggagtttcaccatgttggccaggctggtctcaaactcctgacctcaggtgatccacctgcctcagcctcccaaagtgttagtattataggcatgagccaccgcacccagcctcaaacatactttagacaatttttcacctcagcactattgacattttaggctatgtaattctttgttatgggggctctctctgccttgtaggatgtttagtaatatccctggcctctacatattagatgtcaggaagacccctcagttataacaatgacaaatatattcagattgccaaatgtcccctgtggagcaaattcatcccttgttgtgaactgtgatccagagagccaaatagtgatacaaggtttattgttcacaatagctcgtcccctccaatccagacatctgcctcaccatattccactccccagaggcaaccactttcaacaatcttaaatgtttcatttttattctatttaaagcctttgctcatttttaaattgggttttgtccacattattgagtggtaagagttctttatatactccacagccagttgtggtagtataggcctatggtcccagctactcagaaggctgaggcaggaggataacttgagcccagaaggtcaacactagtctaggcaacatagcatgaccctgtctctaaatgagtctttgaagtatatatattctaggtaattgacctttatcatgtatataatttgtaaatatttcctctcaatctattagttgtcattgcactttcttgatagtctcctttttaatcttgagaaagcataatttatttttcctctggttggtgtgctttaggttgtatgtaagaaaccattgcctaatccatagtcatgcagatacatccctatcttttttttttttttttttttgagatggtctcgctctgtcgtccagattggagtgcagtggtgtgatctcatggctcattgataactgcagcctctacctcctaggctcaagcaatcctcccccttcagcctcccaagtagctgggactatagcaccagctatagtcagcctcccaggtagctgggaatatggcaccaggactatagcacataccaccactaagcacagctaatttctgtattttttggagagacaaggtctcaccatgttgcccaggccagtcttgaactcccaggctcaaacaatcctcccacctcagcctcccaaagtgcaggattacaggtgtgagccactgtgcctggcctagagaggtttttttaagaaatagtgaccaaaaatatcccacatttgatgggaattgtgaatctacacattgaagatgctcaacaaattcaaagcaggataaactcaaagagatccacactgacacacattataatcaaattgtagaaagctaaagacagaaaagcagcaagagataagtgattcatcctgtacaagggatcttcagtaagactaacagttgcttatcagaaatcacggagtatagaaggcagtggtggtgtgctgggcatggtggcatgtacctgtagtcccagctgactgaggctgagacaggagaattgcttgagcctgggaggtggaagttgcagtgagctgagatggcgccattgcactcccgcctgggcgacagagcaagactccatctcaaaaaaaaaaaaaaaaacagggttggggaagctcagcatggtggctcatgcctgtaacttcagcacttttggagactgaagtgggatcacctgaggccaggagtccacaaccagcctgggcgacataaggagaccccatctctacaaaataaaaataattagccagacaaggtggctctggcctgtggtcctagctactcaggaggctgagacaggaggattgcttgcagccagcagtttaagactagcctggacaacatagtgagaccccgtctctacaaaatataaattaaaaaaattagctgggcatggtggtgtgcatctgtagttccaactactcatgaggctgagacaggaggatcgtttgagaccagaagttggaggttacagtgaggtatgatcataccactgcactccagcctggttgacagagcaagaacctgtcactaaaaaaataataaatgaataaaaatataagaatgcttggcctggtctgggcgtggtggctcacgcctgtaatcccagcactttgggaggccgaggcgggtggatcacctgaggtcgggagtttgagaccagcctggccaacatggagaaaccctgtctctactaaaaaaatacaaaattagccaggcatggtggcacatgcctgtaatcccagctactcgggaggctgaggcaggagaattgcttgaacctgggaggcagaggttgcagtaagccgaggtcacacccgattgcactccagcctgggcaaaaagagggaaactccacctcaaaaaaaaaaaaaaaaaaaaaagaatgcttggctgggcacagtggctcatgcctgtaatccctgcactttgggaggccgaggcaggtggatcacctgaggtcaggagttcgagaccagcctggccaatatggtgaaaccccatctctactaaaaatacaaaaattagctgtgtgtgatggcacgtgcctgtaattccagctacttgggaggctcaggcaggagaatcacttgaacccagaaggcagaggttgcagtgagcagagattgcgccactgcactgcagcctgggcaacagagcaagactcgggctaaaaaaaaaagctgaagtgagtccttcaggctaaaatgaaaagatacaagataataactcagagctatatgaaaaaataaaaatcactggtaaaggcaactatatagctaaatataaaagctagtattattgtattttgggtatgttattcctctttctcctttatgatttaaaaacatgcatgaaataatatgcatctatgttaataggaactaattgtttaaagacataatttgtaacaatatagctaggggacagagaaaggagcagagttaatgtatgctattgaagctgagttggtatcagtctgaactagacttagaactcagcatgttaactgaaatcttcatagtatccactaaaaacaaaactttaaaaatatacagaaaaggaactaagaaaggatcaaaatattacaggataaatcattaaccaaacacaaaagaaggtactgaggagcaaaacactttatgtagaaactaaacagcaggatgacataagtaagttctttggtgtgtgggtttttctgtttttcttttttggggtttctttgagacagagtcttgctctgtaactcaggctggagtgcagtgtttcattctcagctcactgcagcctttgcctcccaggttcaagtgattctcagcctcctgagtagctgggattgcaggcgcccaccaccagacccagctaattttttgtatttttagtagagatgaggtttcactacattggccaggctagtctcgagctcctggcctctagtgatccacccgcctcggcctcccaaagtgctgggtacagccatgagccactgcatccagcctgtttttggttttttttgagacagggtctggctctgttgcccaggctggagtgcagtggcacaatcacggctcactacaaccttgacctctgcaggctcagctgatcctcccacctcagcctcctgagtagctggaactacaggtgtgcaccaccatgcccagcttatttttctattttttgtagagacaggagtcttgctatgtcgcccagcctggtctcaaactcctgggctcaagcaatctgcccacctcagcatcccaaagtgataggattacaggcgtgagtccaaccataagtaagtttctgttttttgtttttgagtcaatctcactctgtcccccaggctgaagagcagtggtgcgatcatggctcactgcagcctcacctccaggcgggagccaccgtgcccggtcaagtaacttttctgtttcagtaatcactttcaatgtaaataatctcatcaatggaaagatcggcagaatcaatttttttaataatgtaatacataatccaaatatgcaactcacaaaatactcactgtagacccaaagacacaaatttgttgaaactgaaaagatggaaagagataatccatgcaaatagtaaccaaaagagagccagggtggctatactaataataccacacaaaatagattttaagccaaaaactgttacagaaaaacattttatgttcgtaagagagtcaaatcacaagaagatgtaacaattataaacacatatgaaccaaaaaaaaaagggctccaaaatgcacaaagcaaactaataaaattgaaggaagaaacaattttacaataatggagacctcaatgcagtggctctatcacagctcaccgcaatctctgcctcccagactcaagcaattctccagcctcagcctccccagtagctggaactataggcacacagcaccacacccagccaatttgtgtatttttttgtggagacggggtctcaccatgttgcccaggctggtctcaaatgcccaagctcaagcaattcacccacctcagcctcccaaagtgctgggattacaggcctgacctactgcgcccagtcaacaccccaccttcaacagtaaatagaacatctagacaaaatcaataaggaactagaggaattgaacaacacactaaaccaactagacctaacagacatatagaaagctctccatctaacaagtgcagaatatatattcctctcaagtgcatatggaacattccccatgataaatcatatgttaggtcacaaaacaattctcaatacattttaaaaggtcaaaattatatgaagggccacatgtgttggctcacagctgtaatcccagcacttagtgaggctgagacaggcggatcacttgaccccagaagttcaagaccaggctgggcaacatggtaaaaccctgtctctacgaaaaaaaaattttaaaattagctgggtgtagtggtggtgaatacctgtagccccagctactcaggaggctgaggcaggaggatggcttcagcttgggaggcagaggctgcagtgacccgagatcataccactacactccagcctgcaggacagagcaggacctgtctcaaaaaacaaaacaaaacaaaaaaaacaaaaacaaaacaaacaaaaaaaaacaggccaggcttggtggctcatgcctgtaatcccagcattttaggaggccgacgcaggtggatgacctgtggtcaggagctcaagaccagcctgaccaacgtggcaaaaccccatctctactaaaaatacaaaaaattagctggaaggggaggcaggcacctgtaaccccagctacttgggaggctgagccaggataatctcttgaatctgggagacagaggtttcagtgaggcgagatcacgccgctgcactcaaccttgagcaacagagtgaggctctgtctcaaaacaaacaaacaaaaaaattatacaaaaaaaaaaagtgaactgcatgttgctgcacagtctaccatagcacaaatgtcaattgcttcttggctttcctggggtgatgggaggtctgaacctaacacagtctcacctgatccttcacaggagtcacgtagcctttctctctccagtccacagatgtggggatctcaagaagcaggcgttcctggaactgtttcccgttcctgtgcttctggtattgaaaaccattcatcacctgcctgaattcttcagtggtcttcaaagaaaagtaaataaaatgttaagaagcaagagattaatttggtaaagaactgaggaggggaagcacagagctgggcagcccacagcatacttaccatgtctccaaaggtgttcatggccattgtgaagctgtgtttcccttggctgtattcctgattgtgctgctcagtcatcttcatgttctctcacactgctctcctccatccttcttcattctaaaggcaaacatgtaactgatgttcttcatttctttttttttttgagacggagtctcgctctgtcacccaggctggagtgcagtggcacgatctcagctcactgcaagctctgcctcctgggttcatgccattctcctgccccagtctcccgagtagctggaactacaggcgcctgccaccatgctaactttttgtattttttttttagtagagacggggtttcaccgtgttagccaggatggtctcaatctcctgactttgtgatccgcctgccttggcctcccaaagtgctggtattacaggcgtgagccaccgtgccccgccaatgctatttatttctaattaaaacccaacatatgctaaccaagtgaatcttcagacagagatgtaagagtaaccatggccagggaaggcttgacacttctaggagatgttttccaagctgagacacaacaagggtgtatgcccatatcgtgctcataatcagtgctattaagttattgtgttagcttattggtaggagccagcctctagaagccactctctggccatatgatcccaatagcaatgcccatctctctggtgttcccctggacagtttcagatgccaccaaccatgtcatataatctcttgtgctttgccttccacttggtccattgtgcgtctagactgtggtcacgtgttagagcagctgaggcaattcccaggaaaaaggcagccaggaggagtgaaggattcatgtttcaaaaatctaggaagggaaaagaaatgaggatctgattagaccgatcctaaaaagccattttactaccccctgagaaactagggccaccatggtagaataaaaatatttaaattattcttccaagcatttacctaaggactgtggaagaggccaaggatgtggctggagaaaaacagggcaagtggaggtattggagggacccaccaaaatgaaaagcagcctgtccagagctgtaggagttgaaacagttttctgggatgatgatgacaggctatgaaaaggacaggaaggtacctgatgggcgagaagcttaaggcaacaaccgggaaactaggaaaccgttggcccaggttttgtaccaattgtgctgaggtcatccaggcaaaacctcaagaatgaagacatctaatttcaagaagggacaaagggatccccaataattgggaagtcacatcacaccttgttcttggctaatacacaacagaaggtgaagtatgttttccaaatgccccttgtaatgaaacagttattgaatgtcttcccaggacaaactgggaaggagagcacccatctaccgccgttcccgcagtcctgcagtcctgcaggtgggccagtcctgccaacactccagctcccctcacagagcataaactgaatcaggtggccgaaccaccggaagccagagtccccagtgtccgcgcccacacaggggtgggtaggcagcttcccaggctttgggctggggacccaggccaggtcccctggctcttgctcccgccctccgctcatgctcactgtggccccaggacgtgggcgatgttgcagggagcaaggggcgcctctgcctgatttgccggggtcgagcctccctgtcccacccccaccggccctgggaatactgcggcctggcactccggaaaatccctcactcacagagctgaaggacttgctgggtccctggtggcccctgtccaatcttagcccactggggtctcagctgctgtagccacaggtggacaggcacagtgggcaggtgctgggtccaggagtctcctgtcgcctaaggccgcccgaaagcagctaattgacctctaaagcccctagacccccctgcccccttgccgcccaggcaggcccgcccccaccacttgcccgctctgcgattggctgcgccagccgctgggcggggccttccggcgtgctgactcctggcatgtggagcagctcagtccccttgcctcagtggaaccgggggaggggagctgggggctacgaagagaagggtcggaggtctccctggagggttcggatcaactaagtaccctatttaatgccctgggcgggtggtttatgaaaagaaatttacaggagccctgtgtgcattttcagcttaaccctgcttttcccttaggcctagaatttttgattaaaatctcctgcagggcagagagccagaggactgtaatccagtggttcctgtttagtccacagcaaaggtgcggctggctggaagaacgcacagcctgcaagcagaagccttatctcccaattaagggtgtagaagaatctgggcgtgttgctggtgtctcatgcctgtaatcccagcactttgggaggctgaggcaggcagatcccttgagcccagtagttcgagaacagcgtgggcaccctggcgaaaccccttctctactaaaaatacaaaaattagccgagtgtggtggcccgcgcctgtggtcccagctagtcgggaggctgaggcaccagcatcgcccagcccggaaggttgaagctatagtgagccgagatcgcaccactgcactccagcctgggcgagaggagaccctgtctcaaagacaaaaaaacaactggtaggaaaacgcaccctcaaaacacatgatgagatggtcgagaccagaccctaggagggtgggtactggctgggtgggtatccagagaccatgggcgtttcataatgcattgtttcccgtctcctccactcagcgactcttcttcccctgaagtcttgcattaagtaagtgaatgaatcaatcatcaagttaatgaagctctgactttgtacttgttgtcctttgcttggtacagttgggcactgccttagaaacaatctccaggtaattttcccaactgcttttgtgaggcccagttttccattttaaaatctaagattacctcagtaatcttgcttttacagcaaatgggcatggagcctgacagatatatttaaactaagttatggacaagctgcctggtgcattaggtagcataggagctaaccttgtgggacatctccccatattcgtaatattcacccctacatctataatcaataaatgcttgtttggaggccatagaaactcttcctgagatctgacctgtgtcttctgctatctgcctgatttctccccatagaacaggaaaacactgtgtaggagatattgtgaatagaaatatgaatataggccgggagtggtggctcacacctgtaatcccagcactttgggaggccaaggcgggtggatcacctgaggtcaggagtttgagaccagcctggccaacatggcgaaaccccgtctctactaaaaatacaaaaattagccacgcatggtggcaggcgcctgtaatcctagatactcaggaggctgaggtaggagaattgcttgaacccagggaggcagaagttgcagtgagtgagatggcaccactgcactccagcctgggcaacagagtgagactctgtctcaaaaaaaataaaataaattacaaaaattagccaggcatggtggtgggcacctgtaatcccagctactcaggagcctgaggcagggacaacggctcaaacctgggaggcagaggttgcagtgaaccgagattgcaccactgcactccagcctgagagacatagcgagactccatctcaaaaaaaaaaaaaaaaaaaaaaaaaagaatataaataggaaatacagtgattcaaataagcaattgttagttcctcagatcagaactgtgagttctatactagactcttacatgttatttcttctggtatcttagcaatgattctgaataaagatcagactccttagtcggcaggtgggacagttctcaataacagaagctgggttctcaggggatcccgtggatatgaggatgaaggttagaagcacttgggaccatacctgcaggtctgatttgaggacaatgagaccaagacaggaaggcagcacctgctgaggggctgggggtgggagaagggaggaaacgggacacaagaaaataagtataaaccaccagactgcagtcagtgatcaacaaaattcccaagtttatattgagaagatttccctggtttggggttttgaagagattatataagggattcgggttgcttgatttttttcattctttttcttttaacttggtctcaatttttttgtaaaaaaaaaaaaaaagaatgtcttatgtgcacctttagaactggtgaatgaatgaacctccctttttaaataactgagattgtcactgaagcactgtcatccgatttaggcttaaaaatctgacactgaatttatcctagatgataaagtgcaagtctcttgtctcctagaaatgatcaggcaaggaaacacccaggaggcccagggcaaaatgccctcctggaagctggtggggtaggaagatgctgaggcccagtatggtccctggagcatgcattctgtgtggtgacagaaattgtttgcttgaccgtacattggtcaggcttctgaaccttctgctaaacccatctgtgcactttttgtaaaattcagttttaggaaattaccctgctaagtcagtttagctggcaggaatccccgtccaccatatactgatcagggtcctcatcccccaccatcccgcagctgatgtcagataaccttggcctgtgctcagcgagaatctcgttaggtcagtttagccagaatcctcccttacccttcatgttccctcatagtcatttcctatctgctaacccccatcctcctccttgagtataattaccacttccttgtgctggattcagagttgagcacaattgctctctctcactgtaagaactacttgcagtgctcctagacctacatatgtgaacctgtttctttaacagtgactcacctgtctttttctcctttcaacttgacactagctgaggcttatccgcatcaaagtggagggactggccccgggggatcctcagggcttcaccttgatggcctgcaggctcacattccactttttctggtgccttctggctccgagtccagtttgccacacaagtgatggaggttggaaggagggatgaggtgacagaggtgaaggagggtaaattcttttctaagccctacttgcctgacatgcatttaggtttttagaaaggaacctgaccccaccctttattttctatctcccacttccatgactagccttacctgtaaaaatggggcatagaagagcccccatctcctagggcagtgtttttgagcagggggtcactgaacagtagcaccttcatctcttgagaccttgttaggaaattctggacttggggtggttgatcatgcctgtaattccagcactttgggaggccgaggctggcagaacatgaggtcaagagatcaagaccatcctggtcaacatggtgaaatcccgtctctactaaaaatacaaaaattagctgggcacggtggtgtgtgcctgtagtcccagctaatggggggctgaggcaggggaatcacttgaacctgggaggcagaggttgcagtgaaccaagatcatgccattgcactccaacctgggtgacagaggaagactctgtctcaaaaaaaaaaaaaaataaaaattcctggaaatggattagcttgctgacaagagttattccattgtgtgtttctacctgcaatacctgaggatgcccattttctcacgatttataaactaactcattttatagatgtaattttcatacatttgggggtatcgttctaacttcattattattacttcaaggtgttattatttccccatcatcatcatggtcattatcataactagttggtgctgacagtagtcaccctgcattgagaactcatactccaggccctttccacatagacttgatttaattccattcactcctcacaacaatcgtctgaaagaaagaatcactaagccattgtataattgaaacacaagaggcgagtgacttgtgtgcccttgggcaggtaatttaaacactctgtgcccccaagttccaatagataaatgtaaataataatatctttcttacctaatacatggggtcaacagttaaagtactgtacatttgtgaggtatttcatggcacctgtgaattgctcatgtgatgacttagtgtgcttccagtgtcagtgtgctgggaaggagacagaataagaagaagactgaaaagatgccgagtctagtgcagggtatcctggggaaaacacctcctgtttgtccaacagcgattggccacacattgaagacacactacctggctgtgaactggggtgaccctgttgaaatcttgtggaaagcttgagatgctccttagagggtgtttatccctcgagctggcacaaatgcggtttgttgttcagtttttccttctactctgcctctatctggtacaaaatggaattgaagaggatataaaccagcaaggaacaatctgaaatcagaatggtgacaatgggagaaagtaatcttggttcaacccaatgttcacctgaagtctctttattaaagactactaacaggaacgaaattgcataataatcttcctatgataatttcaagttccagaatttctctatggaactttcaaatttcacctctgttaactcatggaattttccctagaatctgcaaattaccgaagtctttggaggtttgatgatcactcactggtcagcggtactacaaaaggattctggggagtttgactcagtggtcagcaaaggctcttccgaatcttcagtctgattctgagattccccggggagaactggagcctttcttaacagctgttgattggaaagaccacctgcttcatcctctattgcaacagaaatagccattgtgaatctccatggggaggcacaatgagttttttctagcatgtgtgactcaggtcattttgttccgtggtttccagttgtggggacttggcaaggtcacaccctcccctgagcctcagtttcatcgctcagaaaatgaggataacaattctacttgcctcataggattgttgtgaagattaaatgagacatgtaaacatttgcttatagtaatttcacaccactttattgtggaatcaaagacagaattcttacagaggtcttggttagttaagaaaacatccattcaaagatttgattcacaggacaccctcactgtctttctctctctttttttttttttttttttttttgagacagggtctcacttcattgcccaggctggaatgcagtggtgtgatctcagctcactgcaacctctgcctcccaggctcaagagattctcccacctcagcctccgagtagctgggattacagccatgcactgccactcctggttaatttttgtatattttgtagagacggggttttgtcatggtgcccaggttggtcttgaactcctgggctcaagcaatccacccgcctcagccacccaaagtactgggattacaggcgtgagtcaccacacctggcccttgcttactttcgtacttcccaagaggcaggttaccaaattggtgaaattaaccataacatcattgtgatgggcaagcagatatattaaaagcaaagatacagcaggttaacattaaattttgctcatcccaggacaaacctggccacaggaggcctttgccagtattctgaaaagtgttgtgaccatctcctttaaagctcagttaaaggtttctggctggactccaggctgcttcaagctctttacttgtctttatcattctttaaggagggacccagacacagtatgcagaggcctgaatcctctagatcattctctctccaccatgagtcctgccgtggggacttttccagctccctttggccttatgagccagaaaatcaggctagagcctaaagagaatagaaatttcagaatcaggcttgttctgcgactgtatgggggagctgaaggacacaatgggctttctatattggagactacccatcatactctctctgcccagggagaaaggacagatgctgtgtgattttgtagtctgtgatttggcttctcattctcgctgctctctacacctcattgtttacttcactcccctgaaaaaaatgctccctaacaggctcagtacccaacttctgggtattgctgcccacatttgccttggttctaccttttcagattgcaggatcctgaggttttgcttggagcagctcagattctccactagatctaagatctcacctagtcctgaggatttccttaaagggaaggggaaagatagatagatgatagatagatagatagatagatagatagatagatagatagttgctgcctttgctctacagcatctgcttggtgaagaggctcaggatctggatcctggcctctcagctttcaggaaccccattcccccctgacaggggtggcaagttcatcctattattcattaagaaatttgaaaacaatcattcaggaattttaggtcaagagctggaaaaccccaagcctccgtcacctgagcaaagggagatactgtgagcacctgcaggatacacccatgttccaccacctgcctgaagaagcctgtggttcttgtcagcttctcaagggtgaagtgccaatccttttctgcttgagcagaagagcagaccaaagagctcattgactcaaggagcatcacggcaactgagctgcacctggaagagaagaatccagggtgtgatccacagccaaggcctgaagcaatggggcccatacttggcctctccagggtgagttgtgacccaagtgctgggctttagcccatgagtggtccctcttgccatttccagtttcctcccaaagagaggccagtgttggtgatttcatttcttataatctccttaggagcacaggttttggtttgtgccttttttggatcaggttccctgcattgcagctgctataattaaaactattaacaacaacacagcaccacagaagcaagttagttgctaatggaatttgctgataatgctgtcttctagagaccactctagtaactggagagccttggtgtagagctgatgataaaacctattcctgcttttgtcagtcatgaggagcatttcctttctagacagaggaactgaaacccacatgccagcccaaatttaccaaaagcagtcactggaatactcatcacaccatcatgtctcatcttatccctttcgttaccttcaaatacggccccatttcctcaggaccagaactcccttatgtgggcagcaggactaaggcccttgagttacctgtggtgactcctcattaaatggaggaatgtgccagtattttcagcaaaacatgaatctgatgaaacactgactgaactgtctcctagtttcaaaacaaattattaccactcagggcctctatttagggcaatcagagtcagaagtgggaacgcatcttgtcctcctaccttgattaacagtaactctaattgcaggatgatggtcaaatcctctctcctctaatgtgcagttgtgaaggatttaggctccactgctcatgcatttgggtggggcctgaatcactttcagtctagcacaggcgggtcacttcaggccttcccacctccatcagcatccttcaatcctcccctgacatctctcatttatgcttcctattgattcagaggtcccaacccaagtggctaaaagaaacattcattaacctttctacaaagtcatgaataatccatggattacattgaattcatccctactaaaaccatcttcagaaattcagatgtagtaaccttctttctgaatttttttttttttttttttttttttttgagatggagtcttgctctgtcgcccaggctggagtgcagtggcatgatctcagctcactgcaagctccacctcccgggttcacgacattctcctgcctcagcctcccaagtagctgggactacaggcacccgccaccaggcccggctaattttttgtattttgtttactagagacggggtttcactgtgttagccaggatgatctcgatctcctgacctcatgatccgcccacctcggcctcccaaagtgctgggattacaggcataagctaccgtgcccagccaagtattctatccttaatgaacacatatatgcacattatatctattttttataatatatatatttagaattgaatgtcagagtacatatcagtgttggaggaagagaataaggaggaagcacagaaagtaaaaaggaaaaataggcaccaaaaaagatttggagaatggcagatggccaaggagatgcagttgggaagtgcctcttccatggagaggaacccaaatatctagtaaaccttcacattttaaacagatcttttgagagaaaacactgaaagttgacacagaggtgacacagacaccatggttgaagagggaagaaatgggacagtctgctcagagtcactagacatcaggactggcccatataccctgaacaaacccaaggaaggggtgagtgaaggaaccctgggacactacatacccataatgtacctctgagatcctagttacaggagtttctacgaccctcatagatctttggactggtaggagagctgcctcgagcacatgcagaggcacagtttgaacccacacagagcccagaaggctttgttgtgctgtgcagctgcagcaaaatgcaaccctaggtgcccatcccacaagcctccatttcatactgagtggctaagttcctgctgtccgccaggctgggagtgaaccgcgcctggcctgctcacatgcccaagataggccccatcaccagtgctgtgtgattaagttgcatctggtccacatgcccccttgcctgtcaaccccttcccagagctcatgcctggtcacgcctgcaagagggtgtccacagcacagcatccactgcatagcttgagtgttttgttgacagcctgggaaaagctcaccaccctgtccccaagtcacagccagtgcttgaagcttagaggccagaggacaaatccgtgagcccagtcccaactccccaagactcaagtataccacccagggacactgagctgagatttgtaacctaatctcaagtgaaggaggatcctccatagtcagaatgcagagaagggtgtggtatgggttctcatgggggcatgggagctggacacccctccctttgcaagaccagaccatgaagggtatggcctgatggtggtagcttctttcccagggagtgtcctggcacagaatgcctggagcagctcaacaatgtgggagcagatggcttggggaaagcctagttggttgggcttgccgccagggcgagtgtctgtgggagatctgctgggtcaggggagtgtaagctaggcagactccatggttgcctgctgggctgaaaatcatgggctgcagactccatactggtgttgcacccattgtgccactgccctgcctggagatcctctacccttgaaatactgcatcatcagagcaactgcagacataccctaaaacctgctctgactttggtaagcacagtggactggtgggtctctggagagctgtgtgtccctagagatgtaatcctcagtgtggaccatccctaagggaagggggagtgcagcctgccaaagcaccacatgagacaaagaaaatgtggccatggcataagccactgaaaggagcaccaccaaggcccagaaccagacttggagaaggaattatgtctcgcctccatctcccctccccagtgcactgttgcagatgcaacaatagctcttcccataggggcccagaaagcgtgcactgaaagaagttgtttctcatgattctccagtgagggcaagcatgcaccaagaccccacctgccagctcttactcttaagtccatctaccagactgaagtttgagttataccatcatataaaaatacattgctaaaacaagcaacatctgtgaaagccactgcagcaacctatctgtaaccaaggaacatatatggaaacttcaccctctgcaactacagagaaatgaagccaatcaatcacatacaccactgtcatactttcaaagagaataaaaaatataaaagccctgtgatggttaatactgagtgtcaacttgattgtattaaagggtgcaaaatattgttcccgggtgtgtttggagggtgttgccaaaggagattaacatttgagtctggactaggagaggcagaaccaccctcaatctgggtgggcaccatctaatcagctgccagcacggctaggacaaagcaggcaggagaaggcagaagagcagacttgctgagtctcctggctttcatctttatcctgtgctggatgcttccagttcttcagcttttggactcttggacttacaccagtggtttgccaggggctctcaggccttcagccacagactgaaggctgcactgtcagcttccctacttttgaggttttgggactcggactggcttccctgctcctcagcttgcagatggtttattgtgggactttaccttgtgatcgtgtgagtcaatgatccttaataaactccccttcaaatgtacatctatcctattacttcggtacctatagagaactctgactaatacaaaccccatctaaatgaagcaaattcaaaaaagaagtgtcaactcccgcagatggaaaggaataagcacaagaagtctggcaatacacaaagccagagtgttttgtgatctccaaagcctctcactagctccctaggaaaggatcctgaccagatgtaaatgtctgaaatgagacacatagaactcagaagatggatgtcaaggaaagtcaatgagacataagacaaaatagaaatccaatgcaaagaaaccagaaaaacagtccaagatttgaaagacaacatagttatattaagaaagagccaaactgaacttctggaactgaaaaattcactaaataaatttcaaaatatagttgggagacttaaaaacagactaggccaagcagaaggaaacacttcaaagcttgaagactgattcttcaaattaacccagtcatgcaaaaataaagaaaaaatattttttaaaaagacaaagccttcaagaaatatgggattatgtaaagaaaccacttctacaacttattggtattcctgagagaaaagaaagagtaaccaacttggaaaacatatctgaggaaaaaattcaagaaaatattctcaattttgctagagatgttgacatgcatacaccagaaatccagagaacctctgttatacactataaagacagccatccccaagacacatagtcgttagactatccaaggttaacacaaaagaaaaaacaaatctcagacacagctagagaaaagagcaacactacctacaaagggaacccatcagactaacagtggacttctcagaagaaaccttacaatccagcagagattagaggtctatttttagtactctaaaaggaatgacattccagcataaacattcatattcttcaaaactaagcttcataaacgaaggagagattgagtctttctgagtcaagcaatcggtaagggaatttatcaccactagactagccctgcagaaatgcttaagggagttctaaatgtggacatgaaagaacaatacacagaaaaagcacagttaagtacatagtccacagactctataaagcaactacacaattgagactgcaaagaaactagctaacaaaactatgacaggaacacaatctcacatatcaatgttaaccttgaacataaatggcctaaatcctccgcttaaaagacatacagtggcgaattggaataaaaaaatcagaatcacccatctgctgtcttcaagagacccatctcacaactaatgacactcatgggttcaaagtaaagggatagagaaagattaatcatgcaaatggaaaacataaaagagcaggagtttctattctcatatcagagaaaacagatcttcagccaaaaacagaaacaaggacaaaaaaatgttattgcttaatgacaaagggctcaattcaataagaataattaactatcttaaataaatatgcacccaatattaattggagcatcacgatacataaagaaatcactactagacctaagaggtagacagcccctcagtaataactgggaacttcaacactccactgacagtggtagatagattattgaggcagaaatctaaacaaataaattctggacttaaatttgccacttgaccaattgaacctaatagacatctacagaacactctacccaacaaccacaatatatatatttttttctcatcttcacatggaacatactctaagagtgatcacatatgcagttataaagcaagtgtcaagaaataaaaacaatcaaataatatcaagcatcttcttggaccgcagtagaataaaaataaaaatcaatagcaagaggaactctaaaacacagacactcacacacaaacacacacggaaactaaagaaattactcttgaatgacttttgtttgggtaaacaataaaattaaagcagaaatcaaagaattttttaaacaaatgaaaatagagacacaatgaacaaaaacctctgggatgcaataatagcagtttaaaaaggaaagattatagtgctaaatacctacatcaaaaagatagaaatatctcaaattaacaatctaacattgcacccagagcaagtagtaaaacaagaaaaaaaactacatccaaatatagcataagaaaagaaataacaaaaataagaacaggactgaataaaatcgagactcaaaaatccacacaaaggatcaacaaaatgaaaagttggttctttgaaagtgtaaccaaaattgatagactgcaagcaagattaacaaaaaagaaaagatccaaataagcacaatcagcaataacaaaggcgacattcaatcgagtcccacggagattcaaaagattctcagagactactatgaacatttctatgtgcacaactagataacctagaagaaatgaatacgttcctggaaacacacaacttcccaagattgaaccaggaagaacctgaaacactgaacagaccaacaatgaattacagaatgaattgaataagtaatagaagcctaggactagatgaattcatagctgaattctaccagacatacaaaggggagctcatgccaatcctactgaaactattccaaaaaatcgaggatgagagattctcctctaacttactctacaaaacctatatcatcctgataccaaaatatggcaaatactcacacaaaaaacaaaaccctaggccaatatatctgatgaacatagatgaaaaaatcctcaacaaagtacttgcaaaccacattcagcagcacatcaaaaagataatacaatatcaagtgaactttatacctgggatgtaagagttgttcaaatatatgcaaatcagttaatgtgattcaccacataaacagaatttaaaatgaaaaaaaacataagattatctcaacagatgcaggtaaaacatttgataaagtccaacatgccttcataattaaaaccctcaatagactaggcattcaaagaacatacctaaaataataagaaccatctattgacaaacctagtctacgttatactaaacaggcaaaagttggaagaattcccataagaataagaacaagacaagaatatccactttcaccactcttattcaacttaatactggaagccctagccagaatgatcagacaaaagcaagaaacaaaaggcatccaaataggaaaagaggaaattaaattttatttcttcactgatgataggattctatacctagaaaaccctaatgattctgaccaaagactcctagagttgattaaaaatttcagtaaagttttaagataagaaatcaatatacaaaaagcagtagtatttctatacaatgcaatattcaaactgagaaccaaatcaagaacacaatcccatttacaagagccacagaaaaaaaaaaaaaaaagaaatacttaggaatacctctatccaaggaggtaaaagatctctttaagtagaactacaaaacactgctgaatgaaatcatagatgacacaaacaaatggaaaaatattacatgcttatggattggaagaatcaacatcattaaaatgtctttactgcccaaagcaatctacaaattcaatgcagttcctatcaaactgccaaagttatttttacacagaattagaaaatcaattctaaaatttgtatttaactaaaaaagagcctgaatagccaaagcaatcttaagctaaaagaacaaaggcaggggcaacacattacctgacttcaaactatactacaaggctacaataaccaaaatagcatggtttgggtacaaaaacagacacatagaccaatggaacaaaatagagaatccagaaatgaagtcccatacctacaaccaactgatctttaacaaaattgataaaaatacaatggggcaaggataccctattcaattaatggtgctgggaaaactggctaaccatattcagaagaatgaaattagactcctgtctctcaccatataaaaaaattaactcaagattgattaaagacttaaatgtaaaactttagactataagaagcctagaattagacctaagaagctcttttggatattggcctatgcaaagaatttatgactaagtactaaaacacaaaagcaacaaaaacaaaagttgacaagtgagaccaaattaaactaaagagcttctgcacacttgcatgttatattgcaaatatgaaatagcaaagacatggaatcaacattggtttccaacaatggtggattggataaagaaactatgatgcatatacaccatggaatactatgtagccagaagaaagaatgaaatcctttcctttgcagtaacatagatgtgcctggatgccatcatcctaaatgaattaagatgtaaacagaaaaccaaataccgcatgtcctcacttataggtgagagctaaactttgggtacacaggagcaaaaggatggaaataacagacactggggactccaaaacaggggaaggaaggaaggcaaggtttgaaaagctacttattgggtactatgtttactattcagataatatgttcaatagaagcccaaacctcagcatcatgcaatatattcatgtaacaaatgtacacatgcatgcttaatctaaaataaatattaaataatcaaataaaatgaataaaacggtagatatgattatgtggaaaatgctttactatttattatgtggtgaataatttaataatatttaataaatacatgaatgaaaaatagctacaactgtgtgttaggatttcaataattttttatttcattcctataacttttatgtattattatatacataataatatatagttaataataacaaaaacaacatggtattgaaataatttccacccagaaggaggatcaacatatttaagtgactacactactcaagataaaaatcatttatcaaacagatcaaagtcatttacctgctttcctttttataggtcctaggaacacacgtgccatagacaataaaacatcacttcccccatcccactaccttggactttatttaacatctttgggtagaacagaaactgttgataaggtgagttttgttttatagacaagagaggaaaatggatactttgtgtggtctgggccttagaaacagactaagatcttttttttttctcttttgctttttttactagcataaaatattaattgacaaaacactgaatacaagcttcactatcataaaatcaaaacatttaagcaatattccaaaaaagatttgacaaaaactagtcaccaagagtacaaaaattacacatcaacacaaagcataaaaaatgtgaactttcaaattaaacagtcaaaaacatgtacctgcgtgatcacctccacaccttgactgccttcgtctgcagcacgctgctggtaaaggctgggtggctgcaccgtcgtcccctaacccaacattgctttcatctgggaaaattcgcttgatagccaattaagccatggaggctattacatttacacggggctacgcacaatctcaggggacgttcaaacagcagttcgttcctcacacgcactgttgggtgcaaagggcacctggagagtgagggagacctgggagctttcctgcggggccttggccacgcggccgtcgccggcaccctgtcccttgcctggcaggggacacaatatttgtacagattatggtataatttgaatgattttctaatctacttatcttaatttatatagtttatttaaatgtcaaggcagagaaatacattgatcatgttaaggtcacgtgatgtggtggcgcagtaatgacttcctgaggaaacagaaatcggatgttttgtgatttagctatgtgcactaaacttattttccatgttttgagagcacattaaacattcacgtacaatgtgggaataggctggctcgtaaccaaaacgtccaacccaatgccaccctttgaatcgctgtgaacaccatcctattgcggttcagagaaaacaagcaaggctgcgaagccccggggttcaggcagctgcagcgcttgggccaaggtagctccgctctctggtctgaagccacgtggccccaccccggggcggcctggcttttttatagtgcttattgctgtgtttggcatgccattcaacccatcgggatgttggatagtgacttgagagcaatccctagatttgccctgtcgggatgttgcatactgaattcggaataagccctgctcaactgaggcactatcactaggaggaggcactgattcccgcctttcaatgctatctattggtgaaagaggagttggatggcatctgggaaattagtatcacttctactttttcttcttttcttttaaaggttaaaaataccttgtattagttaatactgctataaaatatgaatatccaaatctctgtggctcagtaaaatagatttttttttcactcagagaaagttcaggttcacccttagtaacccaggctgacagagactcttccattttctatacatagcttccccaattgcccagagaagagtggaaagatttgataggtgactgtacacaagaataagaacttagtacctagtcactaatttactcgttgaataaacatttatggagctgaacatattaatcactgggcagacgctgggacacaagaaaaatctttaagatatgtcactgcttattaccaataatgttctagtgagtaacaagagttaataacacgactaattatagtattgtaaatataattacagttccaataagacatacacacacacagaacgattttgtctggttgttgaggaaatctttattgatttaagatatcttttgatgaacaggatttttcaataactatcagaaaaagaatgtctatgacttatttttaaaaactattttcttatctgccttgcatatctgacactttcatctcctatcttccttgaatacaatatagaacctgacatttctttcctttcaaagatccttagagcatttcctacatttaatctgaatgtctttctcagtaatttttcccatacaagcaattatggctacattttcttaatataatcatgaaaaggtgagcaaaactgaaaatttaatttggagaatagatacgaaacattcaattaattcaagttgttgttaggctgcatatgttcagctttcagtgaagatgaacaaatgatgataaatgagaaactgaaagaaaacaaaccaataggtgttttttaagaaacaatattattaaagtgcatgtgttttctactgaatgaaagcaacatagaccttttcctcacattggtagttagtaagatgtataaaaacaactttgtaaagaacaattaatacaggttaatgaatcattgtgaaaaggggataacacactttattgtagcaatgatctgcaaggtgttaaatgttaaaaaagatgaagaacaattgagtagttatttgatcacagtgtttattaaattgcttttcctgtatctggcaagctttacagaaatgtcttcaacagaataactgtgttaaaagccaaatgaaatgcattttgaaatatgattcttcacttggtgtgcaggtataatctcaggtgtaattcagacaagagacaaattcaattttaaagttccatttgttacaatttgatgattgtgattaaagaaccataaaaattttatctttgacatttcattttttcctcacaaaagtattctactgcaattttcttagttttctttcctcttaactgtggtgttacctataaatgctggatttctctgttttacgtgcaacaaatctacaatcaactatttctggaacgccacttcattttaacaacaaggacccataaatattttaaaaattcaaaatgttatatataaaatgttaaatgatacacataatacatttctaagtagtaattatgattatgcccataattatacccataatttaaaaatatgttacctgaagtaaattattatacgttttatgttggaagtgttcatttatctttgatctctgttaacacattgtactatgtggtaataatataaactgccttactggatagtgatgtatctttggtttcatattgttactggactaatattccaacactatagatagtgaaatttaacattgaaacaatttgataatgccatcaatgaatccagtttttaagagtgggatccattttctaaaattgagtatatagatacttcatgagatatcttatcatgcatcctaaaccaaaccaacctcttcccctgactgtcttacagtgtattattattattttatccaccacagcaactagtacatttttcagaacctagtagatattcagtcattgtctatggaatacatgaacacattctgaatttggacagtcatcattcttggtgttttaaaacaaacacttcctgaattgcatccactattttctaagaagccctaggaattcattgaaggagggtatgggtaagttgtgggtgaaactgtaaagatgtaggtcctcctcccaaaacttcttcagcgtatcttcattgctgtttgtttgcttgcttgcttgcttattttaaaagagatctagatatagtctaataagaattgtataaatgtgatgttccacaatgattctaacttacatggtgcaaaataataaaatattacattctacctgtttgtagaaaaccatggatactataaaggatctagattttctctctcctttccttctaagatttattcactcagcaaagacttacctggtgactacttagtgctagacactgttttagatacttgggctataacagtgaaaagaacagtaattgaattaatgaaaagttcattttaattagctgtatggtaaaataggaaactaacaaaaataaaatataacatgtcaaatggcaatgactgctctgagaaaaataaaggagaataagagattctaaattattatatacggccaatattaccaacatattatagaaagaaatgagttcataatgtttatcagagaattccatgaaaatagctaaatttttctagaaagccaggcactgataagagaataaacaaacagataaccgattttaatttgatcttctcttacaggtgcagctatgatctgccattgtatataatataaaattgaaaattgtttatatttcattcacgttagcatataatgttcttacttttttttttttttgagacggagtcttgctctgtcacctaggttgaagcacagtggcacggtctcagctcactacaacctccacttcccgggttcaagtgattctcctgctccagcctcccaagtagctgggactacaggcaggcaccaccacgcctggctaatttttgtattttattagagacggggtttcaccaaattggccaggctggttttgaactcctgacctcagatgatctgcctgtgcctcggactccaatagtgctgggattacaggcgtgagccacagtgcccggccaacgtttttacatttaaatatcagacatctatcatattcctttctccctactacaaacattgtatgcttttcaataggcataagattttgttttcactcaggttggattcaacaggtattatttagcagttcattgcatctatccatttacccaatagaggaagtatacaagatacaaatgaataaagtgtaataattcttatactatttgcccttatgtcatgtaactgctccatgtttgtattccgaaaacctaactgggagggaaaactcagaaaaatagaataaaaagtattatatatctcatacatcctcatttttgaatattctaggggtacagatcagtataaataaaatactctggtaagtgaccaccacatcatctgtttgtcattcttagacccagagtataccattcttttaagaaagaaaacttgctactgtacctcctacccagtaacatatatatcacatatcatatatatatcataacatatatatcatatatcatatatacacatatcatatatctcatatatataacatatttgctactggttaggagtaacactcagaaaattatacttaataatgtagtacaattaggtataaattcacttagtatttttaaattttacgtatattcctatttatatgaatcgtcatttaaaatcacatctactgatcctgatagcattaaaggcataagaggtactgaggatattaatttaattttgtttacagctatgcacagatatttttagttcactgagatttaatccagtagtctattatttgattaattgtacagctatcaaatcattcaggactcccactgtttcaacaacgagagtggaaaaatattttttcatttatgtttatatgcagctatttgtagtctaaattaatatcctagcaattgatggtgaaattaaaattatttctgtcagatgtggtaatttgatgacagtggataagcatgggaataaaagaaagttttgaggaagaggggacagtttttgtttacttaatgattattccaaagatgttaagtaaacattctatagaatgcaacatatagtggaatacagcattgaaacaatttaataatgtagtcaatgaatccagtttttagaaatgggatccattttctaaaactgagcatacagatacttcatgagatgctttatcacgcatcctaaaccaaaccaactccttcccttgactgtcttgcagtgcatagggcatctctacactctaggaaaggaattatcaatctgtttatatgccacttataaaatcatacttaatgtacgattaggcataaatttacttgcatttttaaattttgtaaaatgttaatggaaagtgttcttgaaaaacatttctgagaattccaaaaaatgaacaaattttaatacataagggacaatatctttctagtgaattgattatcagagtgtaatgtggtatgttctgattatgttacataatattctgattagcagaaaattttgaataagtgaatttagcaaaatgtttagaggtcaagaaaactgttttagactgactatgttttctgacccaaatgtaagaaagaacccaataaaaagaggcagccagataatgctgttgtttgcaaacttaaacagaagcttgcatgtaatttatgactcaaagaaaaataaaaatagaagttatactttatttagaacttaatgacagtgaaaaattgcacataaaaaggaagactgttgaatacagcaaaagctggaattatataagaaatataaacataaacacacaaaataagtgtaaattataatgaagtaaaaatatatcaaagagaaagaaggaagcagtacaataaaaaataaagttgattctttaaaaaccatacttaaatagacaaatttccagccagattgtttaccaagtaaagagaaaaagaaggagatagatcaaaagacacaagatgatgatgaaaagagggtcagcacttataaacatagtagaaatttaagccataatgagcacaagaaagcattatcaacttacttttgaatatataaaatagacacttaaaaaactgaacaaaaatgacttactagttttaaaagaaaaaaaaaaaaacatcaaacatctatccttccaaaagtatagacttcaaaagtatagtcccagatgggtgaacataaaccacactttaagcaagaactctcagttataaccacatgggtgaacataaaccacactttaagcaagaactctcagttataaccagatgggtgaacataaaccacactttaagcaagaactctcagttataaccagatgggtgaacataaaccacactttaagcaagaactctcagttataaccacatgggtgaacataaaccacactttaagcaagaactctcagttataaccagatgggtgaacataaaccacactttaagcaagaactctcagttataaccagatgggtgaacataaaccacactttaagcaagaactctcagttataactgcttgcagttttagaggatcccagccacactcctgaaccagagcttggcactgggtattccctctggaacacccttttatttccttctctaagcaaagacatggaatcaacctaaatgcccatcagtggtctgctggataaagaaaatgtggtatataaacaccatggaatactatgcagacataaaaaaagaacaagatcttgttctttgaagggatgtggatgtagttagagaccattatccttagcaaactaacacaggaacagaagatcaaacactgcatgttctcactcataggtgggagctaaatgatgagaacacacggacacatagagtgggggacaacacacactggggccttttggagggtggagaattggaggagggagaagatacaaaagaataactagtggttactaggcttaatactggggtgatgaaataatctgtacaacaaaccaccatgatacaagtttacctatgtaatgaacctgcacttgtacccctgaacttaaaagttaaaaatgaatgaagcctgtcagaaccacccatttagcagtctaacattttccctagtattcccaaatccctttgcctagccaacatttttcacagcactttttgtcttcaaactactggcctgaagcaatctggcttagctttctgagtagctggaattgcaggtgtaccagtgtgcccagccacagttttttcaagacctgtttaagacaacaggttagagaaaatcaagataatattttgagggggaagaaggtaaaatcaattaagacagggtgcacagagtacttgaatggtacagataatgtttatcctttgtactaaatggtgtgtatgtgggaattggttatattattttgactgtttgtagtcatattatatacatatgtgtataaataaaaataaaagaaaaaatataagctaaatttatagatatattaattttatttaaatataacaaagatttgccagtattcaaatgtctgcaatgattcttaaaatgcacagaacctgtgtttaggtacagtatcactgttcatccagccttcattcactcgaatctactcttacctaaaatttgtaccgtaagtaaaattacattctgtatgacagaaagcaaattacaatattagaacaacattatggaaaattggcataacattgtacaatcatccattactttattatttatcattttgcaaatttttattatattagtaaaaaagtctaactgtacttaatagctaatacatatattatttgatatttttaaagaccattattaaaataataataatttgggggtgagaaggcctattgaaaaatgaccaacgtggaaatcataaataagtttgatgcaacaaatatttgtgagtcttatagttaaaaatgtaaaaattcattataaacaaagctaaaagacaataatatgcattgggaaatatttgcaacatttacttcaaaggtggatgtccttaagagaatttttacaaattaataaacatttaaaaaggtgaggagtggcaatagctatgagagacaatttacaaaaacataaaaaatatgaaaactgtttaatctgtaagtacatcaataaaaattttattattgtagttattttatctattaaattaggaaaggtcaatacaattggtaatcttccaagtaaatataggggagaaggtctttctcatacacttataagaatattattttgttagaatgcaattaaataaacacttggtaaaaatccatatcctttgtccaaacaatttaagttctagacctctagaatccacatgtacatatacatatatacatacatatacacacacacattcacacctatatattaacaactcaaatccaactccaactcttttgtaagtagtattttgtccaacaaataaatttatctcaaattcttcttgacttttctccattatagagccagcaattctacgtgtaactctacctctaattcctttatttgcatttatttctgctttcaaacccttatatgaggcaagtgggattaatttatttcattaccttaactagattcatcgctttactttgtcaaactctgattgatttgctcaactcaatcttatgtgttcaagaacttaatgtggattcctgttccaccttatgaaagtcttttccaaaaacttgctaaattcttgactcaagacattgcagtcagtaatgcatttctctcctcaaatacaatggaactgtgttctaataaatactcttcaacaatgtgcagttatttctccacaactatcaattccccttaaagcagaattttactaaaaatggctttatccttctggggataatcagtaaaatggcaattggtgggtgaattaaaaatatactaaaagcagatggcagaacatgagtgcagatttttactacaaagcttaggaaaagcaaaaggaacttgaatagagaaaatgcagaaaagccctcctttggctattaggacggagagagcagaagtatgtttagagcttcaaagagtctgactctttgcaactgtttatcttaggactttaaggaagtaaaaggtgcaagtgaaacactctggattataaaatagaatctgacacagaggattcaacccagttaatatgcatgttgcttacatggaaatgctgagaaatttttagcaaatagatagaaaatgacagatggtaggtatatagaaaataattgtaggaaaaaatgtaaaatgaagatttatggtattccttttatattttattttgttaatatgttgcccataatgctttatttcaaagaatgcaaaaccaaaaaagtagtcccttcctaacttcccctgcagccttgtcttgtggagcttgtattttacttcatgagaaatgccaaggagatgtcatttaagctgaaaacctccagcagaattagccacaatatttgggaaaaagatgtttccagaaaaagaaagagctagtataaatgtccttaggcaagaaagagctcacgatgattgaggaacaacaacaaaaaagattatttcactcaagaaaagtgaattgggagtacagatacaaatgatgaggtctgaatatgattcatggggcaggtcacactaggttgtttgggtatggtctaaatgaatgcgcggcatgagttgctttaaggagaggagtgacatgatttgacaagttcttaagagatccctttgattactctggggagaatagaacataaagtagcagaaatgaaagcaaagggagatagtaggaaataattgcacatttataagcaagaaatgatgttggcttggactctggttatagcaacaaataaagaaaaaaggaaatactgagaagagttgattggatttgctgacattctcaacataaatggaagtcagtatttttttctaataaatataatatgcgtaaatatttttaaatatttaattcttttaccactaatggggcacgagtagacttcagggaacatgccagtacagaaccatataaatgtgatcattggtagagataggaattaataggcatttgaatgtctccctcaacctggaataccacaaataaagctctttgcttttcatgttgcattgttatcataccctatagttttctgccattttcagttacttaatattatgttttgcctcaatagattatagtgctttctcttgttgtgttatatttgcagcaattattagtgaagttttaaacttcaatatcacatctaaaacagagcaaaattgttgcatactattttccattaaaacatgagaccactatgacaaaaaaagctaaacatgtcatgaaatgacttacattggatgaaagtatatgcaatatattaagaaataatctctgactttatagttttttatttgtagtttttactagaacgtgaaatcaatatgtgaaccctggctggagtttgcatctaaatgtaataaaataaaagaaactttaatattatcattgaagcattaatgtacattagcgagctggactatataaaataaactttattatatttagcatttgatttttatttatgtatattataaaatgaatatagtttatattataataaaaataaaagaagtagtatgttaactaattagtataagatgcctacaaactacatatctgcctaaatttttgacccatgaaacttcaatgatttgtgttaatgttaaggcctacatttatttatatatatatataattaggggaggaattgttaattctttcattttaaaaattttaactttgcagacaaagttgactatacctgtggcagaacactgcaacagctataaataaataaataaataaataacttttattttctgtggagctcccagaattatgaattattctgtagattgagatttgccaaggtccttttcttagagttgcaagagcataggagaaagtcaagggaaataataagcagcacttgatttcctttaccacagtggatgggcttctaaaaccaaattacctgactataaatccagatctatcttctgcaggctatgtgattgtggatgttacctcttctgtgcttcaatttcctcatctgtaaaatggaattatagcctaccctattttgtagtatagtgaggataaatagaatgaatgtatgtagttcttagaatagagcatggcacgtgataagtggtcaataaaatattgtttactactagttatgtaacagtcacttcacacataataatgatttaataaaggaataagaagaatgtagagcacagcttctcaacattggcactatgacattttgggtcagacaattatttaatgcagagggggctataggatgcttagcagtgtctctggccagtagtgtacctcctcctctccaagttttgacaatcacaaaggcttctagacattgacaactatcccctgaaaagtaaaattgtccctgcttgagaacacaaatataaagtaaccactcaaagattacattactaattttaattgaatttgaccagcattatgaaataagcataagcttaagtttctacccttgattttgtcattgtcagttagggcagcagagaactccaattctgaaaattctgaacatgtgctaataccctacaatataatcaaaactttcatttttgaattgtatttcttaaaaattagaaaatttattaagcagcaacatggaataattaaccacaaaaatgttgaacataaatctcatttgcctaagttctcttttgaagtcctgtttcactatataagtattatgtgttttgtttcacagctagataacagccagttttttctctgagcctaaggttgcttctcaaatttatggtggcttatagctcttctaagtttctataaaacttcagcaacctgcagcaggttgaaatttattgatattgagttattcaccaggtcatattacaaagtcagggactgactcacccaaaccagatgctccccctgccaccagatcactaggagatattgcaatcatttcccctggctactaaattagcaaaaattctcagggagagagaagggcaagatggcacagtttaatacttactattattcttttattctttatcatcattccctttgaatggattaagaatctgacataaatataacttgctaaagaaagggtgttaggtgagagggaagtcatattggtctaagaaaagtcttagagaaatatttgaaaagaggtagagagaagggttggattggagtgggtgggtggggaatcacactaaggagatggatcattcataatttctttagacatggtgaggcagccacaggagtctgaacttgttgaaaccctagtctgaagccaataaaagtgctcaataaggtcacactttgatcttctctgcctaaagcagttattcaccctatctttgggagaggaaacatctacaaacctttgttctctttgttagcagagggatgacatgaatttgggaaaaacgtttgagagacaaaatgagatttagctcgagcaagtgatcgacttgtgctgggttgcaaatggactttttcaacaggcaggttgaaactgtgcttcagcaattaggataccagatataaacatccatgcacagaattggaaaggttcagctttcatggttgctatggtttgaatgttccctccaaaactcatgttgaaacttaatccaaaatatgacaatatagagaacgagctttttaaagaggggattggatcatgaaagttcttccctcatgagtggattaatccattgataagtcagtggattaataggttatcttgggagggaaaccattagatttataagaaggggaagatagacctgagctagcatgttagcatactcagccctcttgccatatgataccctgtgctaccttgggactcttctgagagtccccacaagcaagaaggctctcaaaagatatgccccatcgaccttggatttccaagccttcttagctgtagaaaataaattcagttctttgtaaattactcagttttaggtatactgctataagcaacagaaaatggactaagacaatggtcttatccagaactttgtaaactagaattggctgtttagattcagtatgtattttttttatagattcaaaataattttgttttgaactgtacaatgaaggagtgtcataagcttttccacatgtagaggctctaaatatcagtctggcattgtgataaagcagagagtttaaacccaatcctatttgtgccccatgaccgttctttctggttacagttcagaaaagtaggaatggatgtgtaactcaaggagaagcatataatacatgaagctttttctcaaaattttgatttagaaaatgaggtattttagtatgttaattataggcatctcaactgagaagtctaatagcattgggccagaattgtcgcagcagtccaaagccatggataaacttaagttaaagggagcaaatactaacagccttccaaattaatctgtattggagaagatgataaacagatgaatgggaactagaaaccatgcagacttggaactagatataaaacaaacagctatctaatgatttcttatttactctgagcccaagatatttttgtatccttttagttaaacctctgttttactaaggaaatttaaataagattctgtctcttgcaagaaaataacatctaagacatcttcgtatttaatactgccttaattttgtttactccagtggtccccaacctctttggtaccagggattcgtttcgtggaagacaatatttccatggacagggttggggggaaggtttcgggataaaactgctccactactcagatcatcaagcactagattctcacaaggatcaaactagatcacttgcatgcgcagttcacagtagagctggtgcttctgtgagaatcaaatgctgccaatgatctgataggaggctgagctcaggagtaatgctcactcatccacctctcccattctgctgtgtggcccagttcctaacaggcccggtaccagtttgtggcccaggggttgggacccctgttttacactataacatttccacacgtctctcatggcctttcagatccactgcttgtctcaactcaagtccagctacctgaaaattcgattattttttcaaagtgaatttgaatatctttatgttgaatacacagtctccacttttacgcagcccctactgtcttctatcatacctctctagccctggaagagatcaactttacattcacttttcctgttttagggctattattttatcttcaattaccaaaatctatctacatttagatactttaacttgcaaatacatagtaaacaattacagattatttaaaatagcagttttcccatgagtataaaaaaaaagaacaataaaagcaatatttgttgagtattttaaagtgccaggcactgagcagtgtgctttgcttaagtaaatgtttgacaaaataaaaggtcctttaaaagttccatgctttaacattaataaccatataaagataaggttagacttcctatcaaattagcagttttgtgaagataggccttttctgctatatagaatctcctcaaacctgagtgttcgtattatggattatctagtatactccatagctatcaagtttgtgtatgtttctttctcaagcaagttatcttatttctccttatttcttcagacttatcctttcttttcttttcttttcttttttctttttttttgagacagagttgcactcttgttgcctaggctggagtgcaatggcatgatctcggctcatcacaacctctgcctcccgggttcaagtgattctcctgcctcagcctcccgagtagctgggattacgggtatgtgccaccacgtccagctaattttgtatttttagtagagacggggtttctccatgttggtcaggctagtctcgaactccgcccgcctcagcctcccaaagtgctgggattacaggcatgagccaccgagcctggcccctaacctctcatttctaaggaaatgacaaattaagtcttttatgcaaatacagtgtagggtcatttaaaaatattttttgtaataggtgtctctgtacataaatctatttaattttttctcttttacagtaaaaaaggcaatactgtgttttagtttcaccaaaaatttcagtagaccaattgtgtaaagggatacatttatatgaatttttttgacatagtaaaaactaagaggggaagttattcaaatatttcagcataaattccctttccttgaaattgcaatcgtcatgtgtagctacaattcctcagcattcctctgtagtataagtagctacaattcctcagtataagaaacactaaggtggaaaattaattgttaagagaacaaagtcataacaaaacaacaaaacaaaaaagtaggatatagaaacattaactcaatatcactcttgaagctcacataagagaaattattgtactagacactgtggttcatcatccagaccccatcttcatgggaagacatcgatcccacactcatggggaacatcagcagctgacaattcacacctgtacctttcactaaatattgtcctaagacaaactaaaatgaactaactcgcccaaagtggtgcctcctttcagagagcagccattgacccatggctggctaatgtagttatacaaacatgcaactgctttgcatcaatttgggacaactctgaaagaggcccagtaggattggctgaagactcagttcaaagttgtcaaataaagcacaccatgcccagctgaatttacattgtttactatgagtatatcccacgaaatatttaggaattacatatactaaacattattcatgatttatatgaaatttaaattcaactgggcaacttgtacttttacttggtaaatctgggagcttttccttagttgcatctgcatggcaggtaagcatgtcggtatgcccagacctcccttctttgcttccttataagtgcgtcccagaaaacaagcaatcatctcagagccaataggcattgaggcttttgataatcaaactcccaaaggtcaaggaaaaagagagtatcccaaaagcaccaagagaacaaacaaacacataacatacaatggagcttcagtatatctggcagcagacttttcagtggaaaccttacagccaggagagggtgacatgacacatttgaagtgctgtttatgggtcccttcggattgtaacggggaaaacaagaattgtagcaggaagaattaaaagaaaagagagaagctttttttttttttaataatctgatctttttctattgagaggcaggcacccaaatgctgcttctgtcggggagtgaatctgtaaattctttgtaactctgtgctacctatttgttaacctgtgtaatttgttctcctgctgacttcttgcaaacacttgccagtgggtatctgaagcctcttacatcttctgtggcacggacttggcctatatttagcatattcactcatctaaagtgggaagaagaatctggcatcttttctctttctccatcttgccatcaaaagctgcctcaatgagcatgtagccttcagaattttgaaagcaagaagcaggcaacaactggccatgtttagcttcatcttgaaactcttgaggacacctatcaaactttcccaaaactgtctcatcatgtatggttccattgcaggatgggtgcaatgctgagtgccagaaggagagggatatcccattctttccttcttaaaaattgctcccagtctttttgagctctcttcctgtttggaaggagaactaaagcaagtttagttctccttacaaaagagaaaataattaaaagcactctcacttaggtaactaattcactttctatatgataattcttagaatgtctagtcctctctttacataagagtacaggtaattgaggtcagtgaaggttttagttacagaactggtctggctactttttattaaaacctgcaaagacttaactgttcttctataatttagggatactcatcatttaatagggaataaacaaaaatttgagacaaaaggaaattctgtatccatttcatatatatacatgtaaattacatatagaaaaaatggtttagaagaggagttaatatcaatttaaaaacgggaattttaaagctgggaataatacatagcataaatatgtataaggattcagcaaaatgttagttgaaacagggggctaaataaacttgaagtttaagaaagttaagaaatgaacccaaatatgcataaatctgaggacaaaatttgatattgctgctaataaaaaagggaggggcatcatattgggaggcttcattaataaaagtaacaaattatgagaacaaatagtcttgttatagtttatctggtgaagcattttaatgaggcatagctgtctgttccattaccgaacgacttttcttatgtgtgctctggtagattttcatatggctacactgaaagatattcccaaatgtctgactaataactctatctataggcaactgttctgaaggtttaaagtaaggaggatggggttcatttagaaccagtgggaaaaaatgctaatgctgggctttgaattttatggatgctgtagctgttatttttcaattaaataaatgttttatatgccatgttttgtagctatcgcagttaaactgccctcatctttttgcccagcaaaaaacccattaagatcttcactgagattgagtctaggttttttataaaattaataactttgctactggtttctcaaaaatgagtagaaatgacttttcaatgcaaatgccagtttttgatacagtgaaattatcctgtctgcagtgactatttgaacttttatcggcaattggacactgagagacttagtatatgaacagatttatccttagattatctaatacatgctttgcgccctgcaccataaaacccgatctatttttaaagccttggttgttctgaaaaatgaaatgaaattgtattaaatggcattttgactggggagaaaaaaaaaaacttcatgtggtttaagagaatggatgccggcaattgactgtctactgtttattcaaaacttatagattagcagccagatgtggcagaaagttggctgatttttcattcacaacaaaaacgatgctgtgcttaatgaatggaggtttgttatcccagtaataagtaaaaggaacatgaaagcccttgtgtttaatgttcatgcaaataagctatttgcaggtggcttttgggcagggtcaagtattttcaaatatttttcaaaactgggtcaagttttttaattgtcaaaaattaccagctagaggaaaacctcctaaaaactttattatgctatttcccaagtaaatgaaatgacaagtcacttatcatttaaaaattacatatgaaaattcttttccttatgatttcgtcaataaataaattctagaggattctagatatatttatttggcatttttttttaatgtggtatcaaattttgtggacattctttagagaatcaaattcttaaaatggcattgaacatttaatttaaaatgtccttcttgaaccatacatgtttattaaaaagttattttatataggttatccattaaaaaacaattttctatatatgtaaacatttatgataactgctcattattttggtccatacttatttatctacctatttattaaacaatacaaatcatacgctttgtaaaaataaaggcctagtctaatattactctctgtcagaaataaaataattcagagaagtctgtattagaagacaaaataaaacaaaacagaaaatgatgagaatcacaaaaccattgccaaatttccagctatggcatttactctccatgtggccttaggtatcttactctcttattttaacctttctttgattactgtaaaaataatttgttactaagaagccctcttgctttagtagctgtgagtataaaattaagaacataattctcaaaaagtgttttagtcttcctggaaacattttaaaatatcaattaatcattgaacaatacacaatcgcctgatcatttgctaagagagggttgcattctcatctctgttcacttctgtcctttctgagacttacacaggtatgagagctagaaaaaatattaatgtgtagtaattcaaaatttctcattcatgaatcacttcagcagtgcaaagaatactttgtaatttttaaaaggcatttttattaatatacttctactattctaccccaatcaacagcaaatttacctaaatcatgagactactggtacttctaatttttagaaaagaatgacataaactgctaataaacccaatgaatcctttacccgcaatgagaatgtccacgagtcagctcttctgaccctctggccagtgttctggagttactgatctccaactttctaattgaactctagcttggtatgtgagagcagccatgggtgaaccagtggagcaagatttaagccttgacattgccattaatgattcaccacctgttgcaagttcaataagttattcacacaccaaattgtggccgcagaattctgggagataaactaagttagaaagattgggggtgaataaatgtttgctaaatcagaattgttaatgatagaaatctgtatcttaacaaagttgagaaatcttgtcttcttaacgtgtatttattgacttcccaggatatgtcttagtgaggaaacatagcttctggcatttattattagagtgataaggaataataaaccacagtgcttgagagacagggaaaggcagggggagccagagacacagtaacagaagcagattaattgactgatgaaataaacttgagataagagagcacagaggaggttcaagagatggaaccatatattcctctctatctgctcccaacatcaaggaaattcatagcatattttataatgaatccctgataaatattagtctataattgaaaatctattaaaatgactatttcttagggtacacaaaaatattacaacaaaacaagtaaagaaaagttgccatgggatggaatattatattttcctgcatgtctgcttcaaggcagaatcctaatggtcatgtatgtaggtaaattattctttttacagcaacttctgggaggtggtatttggtgcagtataaaaggcaaggggtgtagtgagggtaaagcgtaagtactttgatcttgagccttgactatattggacttgggatctcggaaatcttggggataagcagtggattaaatccataaattagtaaagtgttgattatacaacaggtagaactacgtgccacttttggagggacagtcttcttttttaaaaaaaacaaaaggccttaaaggctttatgtatatataaagccttttttaattataataaatacatttttttaatgaaacaatctgcacatatacaattccactctcaagaaaggcagttatttacataattatgcagaaattcctataattatgaaaataattgcctttcttcagagtggagttgtatatgtgcagattgtttcattttaagaaaagaaatatttactgatttgattaactgaagttctggatgcttaaaaaatgattaaaatacacagatctactatctgtcttcatgaactttaaatgtcttgtaagaaattcaagtaataaagactacaacatttattatttaactggaacatgtattatttattatcctaactgtggttaggaagcaccattatttattatatctatattaatcaagttgtatcctgtaacaggtttcctgttatccactcatgtcttctaacttctgaagtattgtttaaattacaagggagaaacctagacactacattttctaggatctcaggacaatagagctccaggtgaaattatgctaaataagggcatgagtgtaagatgtggatgtcacagtgaagagatttagagcatttttctggtgacctcctgtttaggtttgacaagcatctaaaatcattgttagcaactttcccataattattgcattttcagcctttatgaaaatagcagcatttttttttcctttctttgcccatgcacaccatctaatcatgagataagtctccttctgagtccctaaatacatgacatacatagattgggatctttttctgacctgttcctgtctgatacattcttcaactctaagatgagttcatactcatcttctgaagcccctgggaaatggaaatattttttcatattggatgttggtagagacccatcatttaatgaacatttatgtgccaggatttgtacaagacacttagatacattattcatgtacctcacacaaatgtatcaacaacacaacaaaatgtctgtatgaaataataattattatatcccttatatggaaacagatccagagaggaagatacactagcatgtgtaaatagaggattcaagtattaaacatccatctgtccaactgactacaacctctttcataaaatgctaatttctctcctgcttctaattttcttatcaaaaattgtcatctattgttattgggtctatgggtgggtagtgactccttggtttccattttgttctagcggattactgtcttctttatttttgttctagtgtttattgagagtcctaattaattaacctggctgctctgacttccatcagctcaccattgtctcttctcccagctcataatttctgtaacagagctctaggctatgctgaagttctgctatatgttgccagtctctctagatccaagtgcctcttgtcggccaagtttacatgcacgtgtttaaaatcttcttattgactctatatacaaagtcttcacatgccttcctccttaaaataatagcattgtgagaagaaaaaaaaaatcatcattctttttaaaactaattcaggatgtctatgttatacaacaacaagacgtgggggaatatttacctggtagttctgtccctcgttatcattctcactcattataaaattggtatctgaaaaaaatcttgctgcaaaaacaaaaaaaaaaatgtatagggtataaagaaaaagtttgcttcacatcataaccattacccatcccattgccaaagggaagattgtacactacatgattccggggagcagcattcacatagactatagtgtgcatggtacatgcaagagaccccatagtactacccgctttgtcctccttgtagacatgctcacagatgatccatgctccctgacctggagtagtcaaataaaagagtagcatcaatttattaagattctttccagaccattttctaggtattcccattatatattccttcaaatggaaggattttattctgtacatcacatctcactgtacacatttttttctgaaatctgaaatctgagtattttaattttatacagtttcaattgtgagaagtacctgacagactgacctgacctaacactctctaagctaaaacactcataaactagcatagaagctttacacatttatccatttctctaatttacttatctattgtttcctgaaacatctattaatcttgcagttatttgagatgactgtgagcttactatttgccagggatggcatgagcaccttggtttagtctagtgcctggcatttattttcctaaactgtggcagcaagtttagctgtaagcatattttttatcagaacaatcatccatctttaactacatgtgaggaaagtactttcttatattgcattacacatttttatatggccacagaaatccttacttagtctgacaaaattatggtagatttctttctcctaaggtcaaggaaagaatcattctgtactgtttccatggagatgtttctccttttctcaattgccaattgtctactgtgtgtcctgggttccttcttttcatatgtcatgaggattctcaccccagcattctgctcctctgagtcaaagcccttgactttcacttctcaattgttttgtttgcagtttttttgctttcctttatttttcttactctataaatgctatgaaagtgtatgtaaaaatttacccatcttttagtttatatttgttatcaccctttattcatataccaaaccatataggaaatgaatataaggagatctttcttagtaggaggtagaagtaaaattttgtttagaataaaaacagaaaaaaagagaataaaattccatatcaccagtttgcttctaaatgcccaatgtttccacttatgagcttgctactgtacacaacgcaagggcttgtaaaaaattgtctaaatgatagtggttaaggacgtattttaggctaggttactttaaaaaaatatatcatcacttctgccgtcaaaagtgaatttgatgtatcataattgttaaagttgaggagggtcaaggattcttctcattctatggtttccttataaatacactttctaataaatgcctaatttttttctgtgaaattaaaccattagatattgctgaatgtctgtatgtttcttacttttctagaatctcattcttaattatagttttatatttttccttcaacaaagtcttaaaacccatgcagctggtgtctattatttacattctgtgatgtattttatttgactttgtgtttttagtcttttcacagaaatccttttattgtgatcttcttgtccaaaagcacttatttcatatctcttttccatacctatcttcattagcaggttgcatttcagtttcttcagtccttttttagataatatattttactacatctgccttcacaacactgtatacgctctgatgatcaggtctcccttctttttttttttaaaattctcgtcctctttgggacccgtgacaaagtaaaaggcagatttttttctcacctgacttaaaagtaaaaaggtggccgggcgcagtggctgatgcctgtgattccagcactttgggaggctgagaagggcggatcgcgaggtcaggagatcgagaccatcctggctaacatggtgaaacccgttctctactaaaaatacaaaaaaaaaaaaattagccgggcatggtggcgggcgcctgtagtcccagctactcgggaggctgaggcaggagaatggcgtgaacccaggaggcagagcttgcagtgagccgagatcgcgccactgcactccagcctgggagacagagtgagactccatctcaaaaaaaaaaaaaaaaaaaaaaaaaaaagaagtaaaaaggcttcatatgtttctcctctgattcttcttaggcccagcatttccaaaaacaaaatagtacacaaaacattagttgtaatgatacttcaaaaggttcaaatactagtttttggctgctttctgtctatatttttcttctaaagaaattttgttatgaagtattgaactattcagtatactttaatattttccaaataaagtttccaaactgatatttaacaatattctcttatattcaaacatattctgaactattttctgctgtgtctctagatcaatatttataaatctagattgttcatgtattttttttcctttgctaactttcaagatcatatcaaaaagcaccactgttgattccattttttatgtttcattatttgaaactatattgacatttttcctcttctttatcattccctgttatctcatctttgtgagtcttccaattaatgttttttcctttgaattatttattttttaattgaaaataaattgtatatatttaaggtgtaccacatgatgtcttaaagtatacatacattgtggaatggctaaatcaagctaaacatacgcattatatgcattaccttgtaatcggaccccttgagatgtcaatacctcagcatttttagtgattgagataacaaaaattcgaattaggcccttgcttgcttgcataaaagccaacatcccttgttctcacaatacaattgcaaactgctgatttactatttctttgtcaaccaggagaagataactttaaggtaacaaaaaacatttgcagaaggaatgaatgcctataaggatgttgcaactaactgctgaggcccagaagtctggttgctcaggatattatcagagattaaagaaacacagactttccccttggttccctaaaactccccctctcttactgtctagctgcaaaaatatcctctctgcattttttttttttttttttttttttttgagacggagtctcgctctgtggcccaggctgcagtgcagtggcgcgatctcggctcactgcaacctccgcctcccaggttcacgccattctcctgcctcagcctccctagtagctgggactacaggcgcccgccaccatgcctggctaattttttgtatttttagtagagacggggtttcaccgtgttagccgggatggtctccatctcctgacctcgtaatccgcccgcctcggtctcccaaagtgctgggattacaggcgtgagccaccgcacccggccccctctgcttcgtcttattgttaagacatgtctgagagatcttgccccgttctcactttggccaaatggaataaacttttatctatccccaagcattggtgtgtcagtgtttggtttcaactgagcatcaggtacatgagcccgaatttgggcctctacaacatcttcacctacttactatattttgtgtgtgtggtgagaatacttaaaatctactctattggcaattttcaaatataaatgtattgttattcaccgtagccaccatgatgtgcaatcaattttttgaacttactcctcctggctaactggaattgtgtgtcttttgaccgacatctctgcaatttccccatgccctagcttctgatgactaccaattaactgtctgtttctatgagttttacttatctaaactctctatataagtgagattatgtcatagttgtttttaagtgcctggcttatttcacttgacgtaaagtctcccaggttcatccgtgttgttgcagaagatttcttccctttttaaagcccattaaccttttatagatctggtactgaggcaatgcaaacttattggacaattatatgttatttgaataaattgaaacataacagcttataaagggtcaaatggcagttaatagcctaagaaataggtttggaatattatttcttagcataaaggataatactggtcagagtcttctaggcttgaattcttggctacttagattttatcaagtaaattgtaaaaggatagtcaatcacttttttcacatgaattgctgtatgaattttgatttgacaagaaagactgtgaaaacaaaaccactattatctgtgaactacctaatgtggaaagaaatatccttaaataaaactttgagaaagtagattactcaattttttccgacagatatcccatatattgtaactaattataatatttaattgaatacaaaatctttcttcttaaggaaagattttattcagttttagaacgttaaagtttctccactctaatatatacagaacttctttaacctttaaaaatattgcttcacttattactcatgataattgggccacatacataattaaaacacaccatttattatttacccttgtaaaagtggcatctggttccccaacttagcttcaaactgtaattttaaacaaataataaagtgttttgaaacattaatgtggttaattgtcttatctattgtctatgttcatcaggagctgtgacatgcgcaaaggaaggtaatcagaggaaggaagagaagaagctaagttctagagaatccattaatcatggtttagatgactgaccattttattattttccattttccatttaaaaacgttccatttttaaattggaagggggtatgttttagaatagaataacgaaattccctccatctcctcgtagtgtacgtgattaagaagaacctaacagaaacataaggttctaaggttcttgctggaaataataatcagaactgtaagaattctcttatagaaaacatttaaaaaaggaaattctagcaatagaattcattgttaaaactgtaagtcacaacaatattgtctctgcatgctgactgtactcctctgtaatcttcaaaggcaaacaggaacagtaataatcttttcatgtactcttaacttccttctctgaaaggctagaaaatgtcttatatgtagcactcatactgtcatttaatcaaacccagtttctgtttttcttcaatttctaggggaatggctacttagtctttctggcataatgtgaatttcttaagtgtctgtagactacatctcctatttttacttcttgaagtttctctcaaactgtgataaagagtgtcactctatcggtactgttaacaatgtaaattttgtttctctttttgttactgccaagattccactgactgttgaaatataaaagaaaaacagcattaaatcaggtgtgataaaatcacctttttctgtttatctccaccactggcatttattggcacttggaaactatttataaactcatactcttgtaacagtcttgtaactgaaacccactggattcaaaatctattcctagtacttaactttcttctgaaaattccctcatctataaatttgaggatgatgataattgcaaagatgccagggaaatttataatcattattgaactaatccttttgaaaatataaagcagcattaaatgttacgattactaatctttttaattaaagtggcaaatgtgtccaaaaatctgtaactaagttcattactctcatttatgcagctaaacttaagttctaccaaatgtatttttaagttgattaaaaatatggttggcagcatttataaatacccattattaacatgctatactggtaaatatatttctgctcttatgactagagagtgttgtactttagtaaaaaacttatacctcaataattatctgctctcctatttttattttatttgcaatagatatgtatttattcatgcatttgtattcttattgaatgaaggatgttatgtcacttgcattgagtacataggcatccctttcgacaaataaaatcagaatctaaactacagaaccaggttcaagtggggacagaagtacaattttaataaaggtcaaagttttgctagtgtttcacttaaaatttatttttaggctttctgaatgttctcttaaagaaaaagacttaatcatatacgtaccttttttgtattgttaacaaggaagaaacatactaatatgaatggtactacatacattatacatgttatacaagagaagaaaattatatattcaagataaacatttttataatcacaatacttcaacataaatgtgttcaatatagtaaagatgcaggttgtataatttgtcaagcaaattctcaattatgtttgaattctatttaaaatcaacattagtattgacaatattcatatttaaggctttttaattatttaaataggttcaagtttgctgtgttcagcattattagttgtaaaagtaggctctggtaccgaaaatatatatttttagctcccttctgtcagtctttccattaaatgctataggctcacagttttacatgcctctcagcacctcactgctcttgttgcctataatattttattagtttaatccttctgaaataatcctggtcattcaaaaccaatacatcaaaatcttctagagtgaacaaaagaaaaaacatttgtgaagattaaaagaaaaaggagacttctcagatatattaactttaaagactatatctcacaattatgtaatatatttgttgctttatctaattagatttgcatttcttatatataccatgcatataaaaatatatttgatacaaattataatacaaggcattcaaaaatagaccattataataacagaacattttctaaagggattttaaaactgtaagccaaatgccttaatctaatactacttctaaaatgtattctaaagaaataatcttgcatgtgtggttagacttaattacagaaatattcattgtaacctttctttagaagtgaatattgaaaactgaaataaatctaaatgtccaactttataattgctagttatggaatactaacaaatgaaatccatgcttttaaaatagcatttagtgaagcaaatatatgttcaaaatacatataaaggaaaaactggtatgttattaaagaagatagaataaaatttattttgagagtgtatgctaataagacagttttgatatttaggaaaattaaaatgttaggtaatattttaaataaaaaaataaattttctgtttgctgagattatacgtattttaaacaatttttaatgtacgctatagacactgaacatgtataatttatgtatcaagaaaaaaatcaataagttcaatttttaaaatcaaaattaaaagtcacataatagatcagagaagataaagatgaattacacttttttctttatctaacaaaagagagtgcatggtttatggagacagacaatttttttctctggttttaactctaagatataaaaggaatctattgtatacatctggaaataagaggtatttaatacctaatgtatattaagattactgttttagctttttttttacaatatagaagtactgtgtgatgacttaccttatcaaccattgaaagagccattttcaaagattgattaaaatcgaagagttccataagcaattttcactaaagcattgaaaactattatccaagattaagaaaatacttttctagggatccctcatatctagggatctaatgaccattagatccaccttgtataatggaattaggacaacccaaagatctggatgattgaattgtcatttggggattattaccatcatacagctcagtttatggcaatttctatacatgtgtttagtattaattgaaggaaactcataggaattagatgccagacatgaagactatatacatatcttcagagcgcttgtgtcctaaactgaaaagtgtgttttaagagtctgggatatgaaaccaccttttctctattcttgtcaaatccatgtcattctagctactgacataatttatgcaatataaatacaaataatgataagcaaagttatatgaaaatatgtttccagtatataggtagttttaaccattctttttagaagaaatgtgtgtgtgtgtaaatgtcttaattgttaaaatgattaagtcattcacaggtttgttaaagtttttccatgtagctggagtgataataatttgtattacattttagagtggtttgatgcaaataaataagaaccaactcaaaatgttattgaggttaaactccaagaagacaaaaggaaaactaaaataacaaattaaactataattaaaacatttcaactaagaaaaaagtaaaaagttaagctatctcagacaatgttcgagattgaagcttgttaattgcaatggaaaaactgctaattaccacaaatagtaatttagaggcataaatattacacaggtgtggctgcaggaagttgatattaatcaaacacatttggcattttcaatgttgcaaaaattacaattgtaaacaccttccatacaatcaaatgttatgtgaattttaaatgagtctcaataaattatactgcataaaaacaggatttttactatggatcataattgttaatgtcttccgtactcaaggttgaaatataaatcaattcactctattatttggtttggaagtttaagaggacaattcacatttcctttgatacactctaccagtgtcactggactggtgatgtgacaagaaaggtcttctgtagaattgaattgcaataatatggagattataacaaaattatatatgtacctaagaatattgactttaaaagccttcttcagattgcaacattgatttccagatctgttgggaactagctgccttacttaatgtaacagtcttggcaatggaataatcatatatatcacctatggataattaatttttaatcattgaaattcactgaaatatgttgaacatgaaaatcatacaaatataattttgtatgctgtttcagattctttggaattttattctaagcatcaatcaagatggtatagtacgagaaaggtagaacatgtaattataaattcaggattcaggaagtttatttttctcttctttttaattctctcaaaatgatcttgattcctgcaaagtgttagtatatctggtaagtaagagtctatttcttttaaacttcatctgtattaaccagctttatatgaccaaaatgtcccccaaatttaaatctttgcacagtaaggccttatatgtacacctggcctcatttcaaaagactaaagcagttgttctcaaattcagctgcacattaatataaactggaaaactgtttaagctcctgatgacaaagccacatgtgagactaatttatgctgaatcactgggccaaggacccaggtatcagcattttttaaaactatagaggaataaccagggttgagaaccactgcacaaaatggtaaatgcaacttttatttaagttattttttttaaataaataatggttgaattgatactgatcttagtaccaagtcatggcaattttttcagacttagagaattcatcctggcattgagattattaaagaacctagaaatccaagtgtttttgtttatatttttcctgtaaatattagagtatgctagtgctcatccttatttgataattttggaaaatatattaaacatttgagattgaatatcaaaaatctctaaaagaattttagaaataccattcttctatgaaataagtaagctcaatcaagatacatattatagtgcccatttaagaaagtctaataataatgcttgcactgcttaaagattaggttgataaattaattattgttaatcctacttacataatcaacggacacctagggatggagtcttaagtacagacacagaagttgaatacttttaagaacttttaaatttacatccgggttaaattttactttaaaattatgttgagtggttgtgattagtacatgtgtgattagaaccgtctttctcaggttattatatcaccatatagacacaggaaaaataatagaattaaaaataaagcaagaaaaataatgtgacactttattggcttcagataattattttgagatcctaatcctaccaaaacattctgcttttcttaacttgatcctacttttgtttgtttgttttaataaaggatgaaccaatatcctgagaaattttcaaatagggctggttataacactaagaacctagatctcactatgttttagaaaaattgtaaagtatttcaaataatcagtaaagtttcagctctgcaccattgtgtctttgcaatatggggaaagtcacttcacttctctccctctctcgtttttggcacatgtaaggcagagaaaataatatctactccagctatcccacatgttattataaaatataataagagatagaaaatcactttataatgttcaaagtattataaaagtaagccatgattatatgtgggattaacagcagtttgttatttaccatttaatgtatttctaatgtacatttttgccatatttaaaaatgtttacatttcgatttttaagtgaaagagtaacggtatgacattatgccatgttatatctgatgccattatgtcaaacaaacaaacaaaagcattttaaactatttggaatcttaccaaaataaatcttataactatgataatacaggtttttgaggatttcgtttgtacgcaaaaacagaggcaataaaggcaaaaatagataaacaggattacttagaattataaaccttgtgcagagcaaaggaaacaggagggtggagggtggagaggcaacctacaaactgggagaaaatatttgcaaaccttatatttcaatgtactagtgactatcaccctaataactagtcatgggagcactgtcatgcatttggtatgtttttgttttcgggatgctgccacttaccacggcgggagcctgatccctgcggaatcgactgtagctggacttatcttgaatattctgagccaacataccaaaccataaggtgctaattcattcatgcttgaaggccataataatcaatacacattcacgcacacatgtacgttcacgcacacgtacgttctcacacacccgtacgttcacacacacacgtacgttcacgcagtatttaaaggagtgcttccgattaaatccgcagatctgccctccccccatctctgagtttattgttaaattaggtaagccagcccccaaaaacaagatacttaaattgaacctagtcagagccctaaaaatcataatttaaccatgaacactccaaccctagcccctcgattaacgtaattttctaaaaaatcctaacattctccaaccaaataaaatctcctatttcgatgctaactaaatctctgtcctaatacttatataatacttcaggtatcccgctctgaaaagcttgtatcccagatattatagtcctaaatcaaatataacttcaactacaaatggcccctcagcgaaaacctctgctagttcaacttttttaaaggccctaaacttccaggactgtaaaggaccactttagatttatacctaacaagatcctaccccctgacatccccctagtatttcaaaataccactcaaatgtttttcacccagttaatgtagcttaattatttaaagcaaggcactgaaaatgcctagatgggtccgcacaacccggtaaacatagaagtttggtcctggcctgttttttgaattcttagtaaaaaattacacatgcaagcatccccgccccagtgagaatgccctccagatcacctggatcgaagggagcaggtatcaagcacgcataaacgcagctcaaaacactttgctcaaccacacccccatgggaaaaagcagtgataaattttaagtaataagtgaaagtatgactaaactatactaatatttatggttggtaaattttgtgccagccacagcggccatacgataaacccaagctaataaaactcggcataaagagtgtttaaggtctacattcagtaaagctaagctccatctaagtggtaaaaaactccagctgaaataaaacgattacgctccttgaggataagatgcatattgtaacaattttctatatcctccacaatgttttgcagattcaataactatttaatgaattgagttaaatttgcctatactcttacgctcataaataaccttctaattctcaattcctctaaaacatagaaaaaattgccaatataaaaaagcaagaaagaagatattaaccattttgtcattcaaaatatgactcattcttatacaactacctttgtcagcattcttgccattggactatctagactttgacgctggtatatcatggcttgttgttagagaaggtaaagtttggaaaacagaagcagttatgtaaagcaatcttagaaaatccttgagtttcccttagaattttgtgtcttctacatgttttctgtttcacatagattcagtttgcagagttatgtcataatttcatgagcgtatctgtcagagagccctttgaaggcctatttaatccaactaagaccattttttattgttttaataccattgaacttgttctgataattgaggaaaaagagaaagacattccatataatacaccagatgcctaagtgctttggatagtcataagccttttctcctatagcttcctatttagaaatgcctgctcttcagagttttcttaagctttccaacttgctccttccattttataagaataatagtctatttaggaagactattatcaaataaaaatcagaatgatcagtggacacctattttagccttgggatttatatcacaattccctaagactttatatttccagaaaagaaattcaaactaaaggtcacaattactattattatagtaatactgataagatgtgcattttaactaaaagaagttcccactatttttttttctttctacttttcaataatccttgggaccttagtaggagtgtgcagtagtcttgtggtgtatttttagtttaaaagtctgagcatacctaattaccacttggtagatattgttcaaactcacttttgaatccaagtgtttttaccctcatagaattttttttaaaacgagtatttgcttgtttctattatactgtaactattggagctactaggaggccttttaaatttcaccaacaagtaggcagaatggagactaactgaagggttgatgggcttaaagaaaataaataacctaacaaaaccaccaggctaatggcaaaaccaacattaggaaccaagtcactttacttgggattagtggataccaaaatgtgctttctcggaagcagcactttacaaggaaatacggaaatccacctttgttgtccttcagctaaagggaataaaatcatgtactttctataattttaaccctgttataacagatgctacatgaactcaagtggaactctgactgccttgagagctgaataaaatgcatcccaccatccgttgcagccgcatcaaggtattaaaaagagagacagaaggaagaggtgagagaggcacaagttcaacagtgtgaggcagtcagacacaatgggagggagaaagaaataaatgtctgaatgtcattgaaagaagagacaatgaaggcatatgtaagagtcctgctaaagctatggaacctcaggagcctatttgtaagaactacaatttagaatagggaacttgcaatacaatgcctgacctttatttcctttcctgcctcgaacttgtgaaaacctttgattgacttttctatgaacatgaattactgttacaatatttagttgaacaatatgaatttctcaaagcagtaatacagcgctacagcatagcttaacattgtttaagtaatatggtttgcttatatttaagtcatttctaagggacccatgcaaacacagtcaggagatctatttctgatgtatttccaaggctagaaacaaaaaaatgctgttaatgcataaacagtcaaaaaaccatgcactgtggttttacagggacctctatttctaaagatgattgttgcatgagggtctctgcctttatgaagggaaatgtgtagattttaactagatctgtttgtgttttgaaaaagaaaatcatgtttctgcactaaaaaataaattcctaatcaaacctttaaagttaacatttagaacagggacagaaacttctgttgtttcctaagtgttttgctgttgttcctgtttagttttaaatcattttttagaagttttattgaggtataaaaaaattgtacacctttcatatattcacctggatgagtttggaccaatatcatcatcacaaccaaggtactgaacatacttattcacctccaaaaattttcttgtgttcttttttaatggtggtagtatatttttaagaattcagcctttgagcagggtacgaaggaccttcaacaacaaatgcaaaagtaaatgagctaagttcatataaagggttagctctcagtgagatattcaagttatgatcatatcctcaagaggcttgtaaactgactgtgggtttccagtttggttattcacagataggccttcatttgctcattcacctattcattcatatagccactcattcattctcaagaagaggtatttgtccatatctcaccatgtggatgagcagatggtcagttctcacttcttttgccattaagtgtgctcaccgttgagctccaggatgatattttctctcactttgcgtcattaccaaagtggctatcaagattccctcccctaccttctttttcttttttcaatgtttaagagctggagttaatttcttgactcctttggtaacacatgccgatatataccactcaaggcctgttggattaaactgttaaatttgtcatctagctaatgttttctcagaaccagacaaattaaacagagtcaattgttgaaattatttcaaaagataaacaatcatagaatggaaataaactacagaaagtagggaacaggagtaactaagtctcctagaaaacatttgcagcagatgttaagtatccagtctcgttgttataaatgaatttcaaagaatctcatgaggagcagctttacaaaattttactgcactaacaaatggcagccaatctctgtagtaaacacaaaatactgtaacatcctttgtatctccttaaattaagccaatttctgcttacacagaaaatctgtctgtggaaaacactgcttagaatttgaaagcacattaatctggaagccacaacagaagtgtgcttcagaaaacttcttaatatttttcttgtgagttattctctttacgcttttcacattacaatattaccaagttatcataatgtattttctgcactcccagagcaagataagactctagtagttgctgggaactatgcattgtctaaatatgggttcacattctctcacagtgattctggaatcatacacacaaatgagatcactgctgtcagatcactgggattaagactcaacctctctactcactggccatgtaaatatagatacagtactcagatcctctgaggcttagctaattatcagttgatttggtctacacttaccacattaattatttgaaaggattcgttgatataacatgtgctgacaaccataatcattattaaggcaatgtttaccaatatgtgactttaaaacagatactactattagataacaattcacactatacattcaatatttaaacaacagaattataattttgtgaagcaaattttgtactcaaacagaaaatccaattctataattattttctgcaatattgggtcatagaaccaacaaagaatatatgactggcttagacgtatgtaattacttatgcaattagtaataaaattcttcactcattcctagatttgaatccctgatgctctgcgtagcagctgtatagtcttggacaagttgcttaatctgtctgtacctcgatttcctcatttgtacttcaattttcttatgtggtaaatataaaattacttaactcagagctatgaggtcagttttatttgagagaatccagaataaaatacttagcacacatttcctaccattcagcatgcataatacgtactcaaggaaattttagatctctgtacatgattaatatattaaatcctcaaaccgactataatgtctgaaaatgcatgtctttatgtcactgtacctctcactgcacttggcacagtgttgtgaatatatttgtcatttgtatgttctttctaccatacaattctgccactccaattagcatattgtgttggaaaacaattgggtgcttgccttatgttttactaaatttatacggaactacgttgacacttccttgcccttcagatgctggcactcactggttgctttctagttctcaggagtctctgtgtgactctgtcctttacacttgccctgcaacatcaccctcagccctagacaaagccaacatcatttttaaaaacctgcaaatatgtctgcaattcactgtatgaatattctcattctatcaaaaccctgacctcactaactcaatggagcaatacaggatgagaaagtagtttatatgaaagtcatagaaagcttgctttgtttattcatccaaacgtatgtttttaaaggacgaggcttttatctgaaacaaataaaattataatttgaaatttcaaataatgtgactaatatattatgaattcatttccaaatatagaaataattaaaacacttggggtatagaaaaatgagtgctgtatctattcttttcttatattaattttaccccagctgccagaatttagttttttgtttttgttttttttctttttctttttttgagaccgagtctcgctctgtcgcccaggctggagtgcagtggcgctatctctccgctcactgcaagctccgcctcccgggttcacaccattctcctgcctcagcctcccgagcagctgggaccacaggcgcctgctaccacgcccggctaattattattattattattttttttttttttttgagacggagtctagctctttcgcccaggccggagtgcagtggcgccatctccgctcactgcaagcttcgcctcccgggttcacgccattctcctgcctcggcctccctagtagctgggactataggcgcccgccaccgcgcccggctaattttttgtgtgtgtttttagtagagacggggtttcaccgtgttcgccaggatggtctcgatctcctgacctcgtgatccgcccgcctcggcctcccaaagtgctgggattacaggcatgagccaccgcgcctagcgcaaagatgtattttactaataccacagaggtataatctgctgctacttcttgatcaggagtaaacaagtttacttcacagcagttgatctaattttcttccccattcattcaatggtattttttttattgttatagaacatactgaattggataataagtccttttctttttcttttttcagaaatggtttctactctgttgctgaggctggagtgcagtggcattatctcgactcactgcagcctctgcctcctgggctcaagaaatccttcgacctcagcctcccgagtagctgggactacaggtgagcaccaccatgtccacctatataatttttgtattttttttttttttttgtagagacagggtttcactgtgttgcctaggttggtctcaatctcctgggttcacaccatcctcctccctcatcatcccaaaattctgggattacaggtgtaagccactgcacccagctgagaaggctttttattataggttgttcttattgttttatttagttggtttacttgttggttttcaaggtaagtttgacatataaggtggtataatgtttaaaggtcaagttatagagatagctagattgaagttcaaatccagagccaagttacttagactctctaaggacttgttttttcccttataaaattaaaataaagtggatagccacttcataggtttgtaataagaattaatatgatcatgatgtcacagagttgcaaagagatactgaaacttggctctgccaaaaaatattagctattgccattatgattgttctccttaatacctaaggcatttgctgacagtcaggttactcatcatgtccttccaggaaaaaaactttaagaatgttgaaaacttaggaactacttttaaaatttaattttcagacctgacataacacagctgaggaagagaggtggtagctgattggggatagatgtagagatcattaatggtataagagtgtgagaatgtgaagcaggataggatatgatattactcatacagatcacaaatacatgtcaaaattatatttatcattcatttaagtaaaattcaacattgttttcttcaaagaagaaattgcgcatttcactctatctatttaactctggaaaattttacaaattgagcatgccattttttagtatgaattcctttatttcagctgccctgctaactttggcatgatgagcagagaaaaaataaacagaatgattagttctgaaatatgaaaaagtgtctaagaaaaggagtagtcttgagaagtagggaacaggatgaagtcactaggggacagaagggtaggagggagtgggaccagacaaacactgagctctgcatgcacacgtaacagtctaaaatagtcatccagcacgcagactctaagtcaagataaccaagatgaattgccaacttctccacaagcaatatgactttgggtaaggtatttgagttttctgtgtcttagtttcttcaactgataaataaaaatgatggtcatatctacttcataaaattgtgataattgattaatacatgtaatgaatagcgtttggcatttagcttaataataagacttttcattaaaatattagctacttttgttagctagcaactctcagttttgcctaaagctgaccccatatctagggtgaggttttgaaagaaattcaacaccatcagaagtaggtctggaagttataaaggaaagcttaaagaaacagaaatatgtgcaacacctatttacaaagaatccattgggaaaaccccattgagcccagggagatggcacatgtcccctttggttatggaattcagttccctgacggtcagtatactgtctttgttcccaaggcaaactttttaataattgtgatcccactcaatagtcatgttcacttactttatgggtacatttgtggcatattttaaaatgtgaagttgagtgcatttcacctgaaaaccaaaggcatgtaatgacaacatgctatagaggaaaaattattgatttgtgtaaataggcagatcttgtttgtattctagctccatcacttactaattttgtgatatgggcaatttatatcctatctgagcctgtgtttcctctacaatatgaggtaatttctactttgaagtattgttatgagggttaaatataaattactttctggtttatgatgttggtatatactacttctatgcacaaccgttatttttatgaataagattttaacagtaagccacagaaaatataatgtaagactgattcttagaatctatcaaaacaggttgtaaaaatgacttaaacatctagcatggcagtgactaacattttgaaaagcttaatttttccattaagaactatagcccaacacagtgtctgtgcttcagtgttcctcttatcaggaaggataatatgtgtgatgcatggactaactctaatgaaaatttttattcttaagacacaaaatatttcccagcacagtacataaggtctttgtgcttatgtcagcattggagataaatttctgggaaagaagtagagaaactgctcatttctatagacatcaaaacaccaaagtagccgggcgcggtcactcatgcctgtaatcccagcactttgggaggccgaggcgggcagatcacctgaggtcaggagttcaagaccagcctcaacatggagaaaccccgtctctactaaaagcacaaaaaattagccgggcatggtggtgcatgcctgtaatcccagctactcgggaggctgaggcagaagaattgcttgaacctgggaggtggaggttgcagtgagccgagatcgtgccattgcactccagcctgggcaacaagagcaaaactctgtctcaaaaaacaaaacaaaaaaaacaaccaaagtaaaagtgaaaataaaggtacacagcagactttttctttttaaatacctaaactgaaaagtatacctgtcaagaaacatccaactcatgaattactttaaatatgtttttaaaacagcgtgcttgttttataacaatagattcatgctagttatctgatattccccagtggttgctttgtggagctcagtgtcatccttggagaacatgggcaataaaaagcatttcttctgcaccagtaagacaaaaacaaactgactacttctcacataaaccttggagggcttccctcagtggggttagtgatcagcaaatcatgtcaaataaccccttttgttatttttgacataatagtgttcctagcagacagtactcaagaattcccagattcttagctgtaacataaatttaatatactctcttttattaaaagtcaagctgtttattcacagtagctcttaggtctacgtttcattttacacatatatgtggatgtaatagctttttccttagaacttttaaaaaatagaattcagtaaaagtcctatatttgtattttctatgtgtcaagaacagataagcatcattaatgtgaaccaaatttcaattgaggagctgaaattaggaagaattgaaaaacacctgaaataaatcttcaagtaataaaggggaaagtttactttagaattagtgtatcaaaaatgagaaaattggctgggcgcagtggctcacgcctgtaatcccagcactttgggaggctgaggcatgcagatcacctgaggtcaggagttcaagacctgcctggccaacatggtgaaaccctgtctccactaaaaatacaaaaattagccgggcatggttgtacatgcctgtggtcccagctactcgggaggctgaggcaggagaaccgcttgaaccccagaggcagaggttgcagtgagccgagatcacaccactgcactcgaaactcggtgacagagcgagactccataaaaatcaatcaatcaatcaatcaatcaatcaataaaactttttaaaaagtcattgcattatttttaaaaaattaatagtttcaaaatgtatacatgtaaaatctaactgggaatactttgtatctacttgtagcacaagattaaatttattttcaattactaggagatttgcacaatagagtatatatttactttaatctgtatgactaaaagcctcattgtcaatgtgactatgtcatcattatcacattcatgaatctcctgattataacctgcacagatggtctacctacagggctctgggataagaaacttgctgtctgtctacagaggaagccgttttcacttccagatagttctgaatatttgcaagtacttgctgatttagagtcaaattatgtcttgctgtaacatccatgttactgaacttacatttgagataaaccaagattagactaaaccatgccttcaaatgacactctcaaaaatgtgatgcaatttatgtgccaaaactatcctatcttgccattttcctccattttttaggaaaagcatggtcctagttttgttagccacagttgacactactattttaaatcactatgtcatttgtatatcctacatttgaacactctttagtgtcttcaagttaaaatatgcataaaaactgcacgtccaggatactctacctggagaaaaacatagctctcattaaccttgtccagacattaaacttataagagaaaaatcattattttcctgtaaccaaattattccgctaaatttgtttttaggcaggattaataaacctttactgtaaagggaaagaggctaagattttaggttttgtgggccatataatctctatacaactgttcaactctgctgttgcagtgagaaagcatttatagacaatacgcaaatgaatgagtgtgtccatgctgcaataaaatttaatttattgcagtctattggctggatatggcctgcaggccataatttgccaacccttggttgacagtatagctagctaaacactgcttgttgtagtaaaatcttgctttttaaaacgtatgtctctcatcctagtattgtcattacgtgtgtgtggtttattgttaaatatgtaatatttaagggtctttcctatttagttttattaactaaaagctgtttcataattgtaatgcacagacatctatataggtttttattttatcattcaacctattagctaatccttagagttgtttcatttttcatgtgtttgacagatgaacatgtctaaaacactgatgataatgttaccagaatataaacaaaaatgaaattttcaggttaaaaccattttgttagtaatatgtaagtatatcaattaaccattaaataatttaccaaattattccattacctaatccatattgctccttcttgtccacaagaatatagtaaggtacatgtcaaatacatacctctgactttagtgggcatttaatgtattattagaggatcctgatatctgtctttcttaaagaaattaaactcatccctagtgattatactttcttcatctaacactataatattaataacatttgaaaaaataatgtctaataattaacactagatttagagtatttttagacaattttctaaaattatctgaaaaatttgaccagaatcattgtaaaattcacatctgagcttatgaaagcccactttattccactctaaaagaacaaaattttgtacctttaattttatcttttaaaatgttttaacataaaggtagtgggagacgttactaaaggaagcttaggtagtaacgtatttgtcgtctcagttaacacaaagaccatagatggggcagatctgcaggatgcaaaaactttcctttttctcacctcatagtagtcatatggctactgcaattctctggtttcatgtgcttacaaaatgtcctttagttaaaaataaaaagaaagagaaagagaaagacaaagaaagaaaaagaaagagaaagaagaagaaaagagaaaaaataatttcttcatgtgtctatttaaattaacaaagacgtgaattgtcccagacctccctgtgatgagtaacttcatgtgtcagttttactgggctaagggttgcccacatggctgataaaacattatttctgagtatgtctgtgtttccagagaaattagcatttgaataggtagactgagtgaagaggatcatcctcaccaatatctatgggcatccttcaatctattcagagcccaaataaaacaaaaaggcagaggaagggcgaatttaatctgtcttcttgagctgggacatccatcttctcttatcctctgatattggaacacctggttctcagacttttgggcttaggttgaactatatcactaactttcctgggcctccatcatgcaggcaggagattgtggaatttctcagtctcgacatccttgtgagccaattcctcccaagaattatcttcttctagctatctctgtctctttctctatctatttcatctgtaaaagtatctgtatctctgtgtcatctatatctgtatcatctgtatctttatctcatctgtctctatctctatctctacctctatgtctacatctgtcttagttatctatctcatttatggttctgtttctctggagaaccttaactaatatagtccttatcttacaactcacttgccagcttaccatgattataaccaagttgatcacttcaaaagaatactaaataatatatattgtttacactaagagatagctagctactctcctcaagctgaatctggcccccacctcacttagtagagcaagcaaactaaatgtagattatacattttttactcattgaaaaaacccaaataataacttatgacatgctaaaatttaaattttgatatacaaataaaattttattagaacacaattatatttattcatttacatttacattatttgtctatggctacttttacactaatgcagcagagtttgttagttgagacagaaacaggccaataaagaccaacatttttacaatatgaccctttaaaaaaaaatggacccttggtttagactgatcaataatcctatgggaggattttaatgattttcatctgtaaccaaccaagcacattttttttcttggctaggataaatttagaacatctatgtccttccctaaaatagccccacatacttgaaagtctgattctctcataactatatttttttctctgctgttaaaatttgaactcattctcttcagaaataaagaaagtaacaaaatagaaactaagcagtcccatttttattttgccatttatgagggcctatgccacctagcggtgatttagtatgtatttaacaaccagttcactgagaaaaactgctgtatttttagtttgcttaatttagtggtgttgaatatttcctctatgaccaattttggcttacgaatatgatttctttgaatgcaaagttgggaggagatgagcactgtgtgctcctatgaggagttccatctggctcaaacataaacactattaacatcactttgctctagacatgtgattctctttcataatgcttcttgcattaactgcaatataaaagttacaatccttattatttttgaaaaactcaatttgtataggactcttgataatattttaatatgtatacattttataataatttttattgatattttttcttcttttatacttttttttgtttatttatatagtttgttttcacattaaatgggagaaatactgacattgttcaattcacacccagggaaattctgtgtgaatgatatcatattatatttcttttaatgctctaaacaatgttgtgaggtaagtgttatctctgatttgcatatgaagaaacatattccgagattaaaaaattgcccagtttcacacaaggaataaattggagcacaggagttctatatagatagacctgtatgacttcacagagtgaaatggacagataaacaattcactttccaggagaaatcacaggacaatggatatcagaagaaatgatgggaccagggtaatattggatgttttgtatataaaaaactaatgtgggcaacaaaaaagcatataaagtcactgaagcaaaatatatataatatatattgcgaaatctaaaagaaaatatgctattggtaggccatggctacattataaaaaacatttcatttcacataaagtatgaatactacactatgactatgagttaatattaaaatttgaccacataggaaataggagaaaaaagtaacaacactgtggaaagcaaagaaaatgactgcaagatgaagctatcaccaccatctcgtggccacatacggacttcctcagaagcttagatgaataaagggaagagactggagttattaaaatttgtaaactcagagtaaaagccttcctgagctgaggctagacctctgagggagagatatgttccaactgctgctgttacctctgaagaggcactttctggggctctgaaaaaattggtaaactgaaacaattactgctcctagggcaaggggatgttcttgggagaatatcagcaaggacggcaaacaaacaggaaaaggagatctattcttccattctcttgcctatgtttctctagtacctcccaatagcagaacgtagcaggatcccacttgaaggaacttggaaaacgtagcttgctgatccccatcacggcatcatagcaaatttatttcagagaaatgtggctaaagatcaagattattagtaaatcaatttttttacctaatttttaatctgtattgatttcttataacataaatatctgtggttacagagacctcagtattttctttttcttctgtagcagcatttcaatcttttttgaagttctacctctctttcacttctagttcacaccatgtgagaacaatggacctaatcatcatgggcagtggtcataatatgtctcaacctgcccaaaataaagatgctaccccattaaccatatgttttattttgtaatacgatcatgatccaacctagtctaatgagaaacttaactagaaattttgttggaattattgaggaaaacagtgttcattttctgaaaaagtagcttagctagtaagatataagctcagtgctactagtggccatcttgatgtggaacaatactgagaatatttcttcaggtaatcctacaagaaatgtgtgcaaaacagaaaagaggaagttacaatgagaaatttcttacgtactatattcagtagagcctcagggtagctctaaatctagatacttaataagaatactactgataataaataatactcatatagcaaatactatgtgctaagcattctttcatgtactttataagattaatatatctaatacaaggactgtatgagatagatattattgtccagttttattatgtcctgcaaataaaatgccctgacaaattatattctctcaatcatctttcctttgtttgcaatcaacattttatatgtattcacttattatgtatcactcctttgattcctcaaaatttatttagggctatataaatattttgctactactggaattagcaaaactttaaggttaaattttcaaacatgttattgccctcatcatactgtagcaagaattagtaatcaatgatacataaaccctatttatttatccgaattattccatttcacatcctcacaaaggacactattctgtcaccatttaacccttgtccccaaaatctcctcataaatgcagtttcaaaaacagcaaatagataaattggactttattaaaattaaatttttttttttggtgaaatggagtcttgctctgttgcccaggctggagtcagtggtgccatcttggttcactgcaacctctgcctcctgggttcaagcgattctcctgtctcagtctcccaagtagctgggactacaggcacgcaccaccacgcccggctaatttttgtattattagaagagatggggtttcaccatattggccaggctggtctcgaactcctgacctcgtgatctgcccaccgtggcctcccaacgtgctgggattacaggcatcagccactgcgcctggcccttaaaattaaaaaaatttttttaaagtttttatttttttgagacagggtctcatcatgttgcccaggctggagtacagtggcgccatcatggctcactgcagtttcaacctctctagactcgagcggtcctcccacctcagccttctgagtagctgggactgtaggcatgtgccaccacatcccagtaagttttgtattttttgtattataggaattggggccaggcacagtgctcactcctgtaatcccaacactttgggaggccaaagtagatggatcacttgaggtcaggagttcgagaccagtctggccaacatggtgaaatcccctctctactacaaatacaaaaattagctgggcatggtggcacgcgcctgtaatcccaactacttgagaggctgaggcacgagaatctcttgagtctgggaggtggaggttgtagtgagctgagaccatgccactgcaccccagcctggttgacagggcaagtctgtctcaaaaaaaaaaaaaaaaagaaagaaagaagtggggtttcaccatgttgcctagactggtcttgaattcctgggctcaagcaacctgcctgccttggcctcccaaagtgctgggattacaggtgtgagccactgcacctggccaaaattaaaaacttctatgtttcaaaggacatcattaagaaagtgaaaagacaacctacagaatgggattaaatatttgcaaattgtgtatctgttaagggtctagtatttagaatatgtaaagaactatcacagctccataagaaaaaagcaaataatccaattgaaacaatgggcaggccaggtgtggtggctcacgcctgtaatcccagcactttgggaggccaaggtgggcggatcacgaggtcaggagatcgagaccatcctggctaacatggtgaaaccccgtctctactaaaaatagaaaaaaattagctgggtgtagtggcgggtgcctgtagtcccagctactcgggaggctgaggcaggagaatggtttaaacccaggaggctgcagttgcagtgagtggagatcgcaccactgcactccagcctgggcgacagagcgagactccgtctcaaaaaaaaaaaaagggcaaagaatttgaagagatatttctccaaagaaaatgtgcaaatggccaaataaacacatgaaatacacacatgaaaaggtgttgaaatcattattcattagggaaatgcaaataaaaatcacagtgaggccaggtgtggtggctcattgcctataatcccagcactttgagagactgagtcaggaagatcacttgagcccagaagttagagaccagcctgggcaacatagggagataggcgtggtttgtgcctgtagttccagctagtcgagaagctgaggtgggaggatctgcttgagcctgtgccgtcgaggctgcagtgagcagtgatggtgccactgcactccagcctgggcggcagagcaagaccctgtctctaaaataataatgataataataataataatagagataccaattcacacccactagaatgactataataacttaaaaaaaatctcaaaaaaaaaaaaaacccaaaaaacaaaaccccaacaactgttggtgaggatgtggagaaatgggaaccctataagggttccttacttatagagatgtaaaatgatacagatgctatgggaaacagtctggcagttcctcaaaaagttaaacatacagttgccatatgacacagcagttccattcctaggtcatcccaagagaaatgacaacatatgtccatacaaatacttgtacatgagtgttaatagcaacaatattcataattgtaaaagagtgggaacaacctaaatgtagatcagctgatgaatggataaacaatacgtggtccagctgggtgtggtggcacacacctgaaatcccagcgctttggaaggccgaggcaggtggatcacctgaggttggaagtttaagaccagcctgaccaacatggagaaaccccatctctactaaaaatacaaaattagccgaacatggtggcttatgcctgtaattccagctacttgggaggctgaggcaggagaatcgcttgaacctgggaggtagaggttgcagtgagccgagatcatgccattgcactccagcctggtcaataagagcgaaactttgtctcaaaaaacaaaacaaaacaaaaacaaaaaccagtatgtggtccatccatacaatggagtattattcagccacaagaaggagtgaagtacagattcatgctgcaacatggataaaccttaaaaacattatgctgagtgaaagaagccacgaaagatcacatatggtatgatcccacttatatgaaatgtttagaacaggaaatccatagagatagaaaagagatcaatggtttctaggagatggggagggaggcaattgggaatgactgttaataggtatggggttctttttaggtgatagaaatgttctggaattagtgtagatggttgcaaaatgtgaatacgctaaaactactgaattgtatactttgaaatggtaaattgtatgctatgtgaattttatctcaattaaaaaaaagtataggccgagtgcagtggctgaagcctgtaatcccaggctttgggaggccgaggcgagtggatcacttgaggccaggagttcgagaacagcctggccaacatggtgaaaacccatctctattaaaaaaacaaaaattggctgggcgtgttggtacatgcctgtcatcccagctactggggaggctgaggcacgagaattatttgaatccaggaggtagaggttgcagtgagccaaggtcacaccactgccctccagcctggtcaacagaacgagactgtcttgaaaaaaaaaagataaattatggtatttgctttggaattaaataattagtaacctttagtaaggtttggtaaaggtttagtaacctttagttaacccagttaacttctgtgtcttatgcttgtctttgtactgaagtagttgaatgccactgacccacagaatgagttgccagagaattggagcaacattctgttgtgggaaagagaatactctgttctaccttaaaattagattaccagcatatcaattgaagggttttaaatagtgagtgatgtgtttcaatttatatttatattatatttacacttgatcttagccaaaagtctgagtagtgattttatattatatttataaagatcactttagctttctcctggagactggattggtagggacaaggtgacattggtgaacttggttagaaagtcagtcaagcccgtgtgcagtggctcacgcctataatcccagcactttgggaggccaaggcaggtagatcatctgaggttaggagttcgagaccagcctggccgacatggtgaaaccccttatctactaaaaatacaaagattaggcaggcatggtggtgggtgcctgtaatcccagctactcaggagattgaggcaggagaatcacttgaactcgggaggtagaggttgcagtgagccgagactgcgccactgcactccagcctgggcgacagagcaagactcagtctcaaaaaaacaaaaacaaacaaacaaaaaaccagtcagtactctagggaagaaataacaatagctatattatgacatagtagtgagttgaagataactgaatagccaaaatatattttggagatagtttgatatgagaggcgaggaaaagtaagtagtcacgtgtggctctttgtttctggctttaataactccagtagttctggaagagacttagtgggaaaattaaggacattttggataaattgagtttgtccaaatggggtttccaagtggagagttgagtaaatgaagctagagctcaggaaagatgtggaccagagttataagtcatatttatttatttatttattttgagacagagtctcgctctgtcgcccaggctggagtgcagtggtgcgatcttggctcactgcaacctccgcctccggggtcaagtgattctcctacctcagcctccagagtagctggtattacaggcgtgggccaccatgcccagctaatttttgtatttttagtagagacgggggtttcaccatgctggccaggctggtctcgaactcccgactttaggtgatcctcctgcctcggcctcccaaagtgtttggattacaggtgtgagctactgcgcccagcataagtcatatttaaaacaatgggaatgggtaggaacacctagggatagagtatgggaaatagagtagggtccagtatacagctgtgccaaatttcacatgtacaggttagatagtggagtgggtcagttctgttgagaatgccctgaaagcttgaataatgataagcacgtccattttaacatcatgaggtagtggtgacgttgtaagaggagtttcagtgtagtgggttgtcatgggttaaaacgttcagattgtcatgggttaaaacgtgaattggatatgaggaagtggagtgtgcaaagatagttttctgaaagttttacttggaagaggacaaaaaattgagactagacagtttgaggaggatgaaaggtcaaggattctaagctagtgataaaaatttcgtcaacatcaatgaataggtaatgtaaacacgttaatcctgggatggatgtgagaagagcaaagaaaggagtcatgggggaatatcagctctaaaggttgagtagagaaggaaggagtgatctgagaggtggaaggaggagtaggaattatcatagaaactttaagcttcttgagggcttgtgactgtgtcatgttcatcattttatctgaagttcttatcaacaaagtagctttcagtaaatatttattaaatgaagacaaaaattttaagagccatctgcaatgtcaaatgtagcccacagttgaatgaatatgaggaccgggaagtgtcccttgattttggagttaagcagctgattgccaccttctgtagaacagcttcagtggagtctccatgatagaaataaatgccaggttgctgaggactaagcgtggatatttgttgagagtggagacagtaagtgcaaacattcttttcagaaagctttgctctttttgaagctttgctcatagggagatacaagatagtaggtagaggggcaggctgtgtttagatgagagagacttcagcatgtttatatgctaaatggaaaaaggaaaaaggaagggagaagttgaagatgtagaataaaggaggtgtgtgtgaatgattgtacattgtctttgaggttagtgggaatggagtgaagatactgggttgcagtacagatgagaatacagtttccactgaagtaggaataaaggaacaatagatggtgcagatggggaagtgtttgggtggcaagtgagaattctggatatcaacactttatttttttcagtgaaggggggataaggtcatccactgagattatagtggggatgaaatgatgattgtaggggactgaggagaaaaggagaatttcaagaaagcctctgagggaagtgagagggcaagctgagtgggaatacttagaaaaaatggaatcatggatttttcacggctgtggtatatatatttgtatgaatgatttcctccttctctcagggctcagcagcctgggtgagcacacaattgaacagttggattggtcttggcctgggttttatgtgtcagtgtgacagagagggtaaggaggcaagatatttcagtagcgagagtgtttgaagtgatgggccattgagtctaggctgaatagggaacaaatgaaaccagaaggtggctgctgggacatgaagtggttggtgttcaagactggatagtggaaatgaagattgaacgggaggagcagttgctgggtatgacagaatacaggatccagctatggagtgggtttatgaagtagagacaacgttcccaagtctttagtgaacatcagagagtgtcatctgttagaactttagctgcggccgggcaaggtggctcatgcctgtaatcccagcactttgggaggccgaggtgggcagatcacctgaggtcgggagtttgagaccagcctgaccaacattgagaaactccatccctattaaaaatacaaaattagctgggcatggtggtgcatgcctgtaatcccagctactcgggaggctgaggcaggagaatcgcttgaacctgggaggtggaagtttcggtgagccgagattgcaccattgcactccagcctgggcaacaagagtgaaactcagtctcaaacaaaaaagaacttttgctcaaaggcaggtggtagcagataagaggtaaggaaaatttagtgaagaaaaattcagtttttaaaaacgttttaggctgggtgtggtggctcacgcctataatcccagcactttgggaggccgaggtgggcagctggcttgagcccaggagtttgaaaccagcctgggcaacatggcaaaaccttgtttctacaaaaaatacaaaaaattagtcaggtatggtggcatgcacctgtagtcccagctacttgagaggctgaggtgggaggatctcttgagcccaggaagttgaggctgcagtgagctgtgattgtgccactgcgctccaacctgggcaacagagggaaaccctgtctcaaaaaacccaaaaaaaacaaaaaacaacattttattttggtgatggaattctctattgtttcgaagagttttgtttgttttaaagacattaaccagttttctcgagggatattctatgaaaaagtgggttccatcatccaataagtttgagaaactgcaaactctatcccgttggtaattcacaatgaacctcaacttagattaataaaggctctgggaaatgatgttactattaatgatttaacatttattgagcactgtctaaggctctgttctaaggctcccacatgcattattgtttccagtctttacagcaactatctcaatttaagtcacacggctaagctggaatggaagagctgggattcaaatccagaaagacttgctccataggattctcaagcctataaccagtatggaaacaggcttgacattaaatccagcatttccccatcttgtttggttatggaaccttattatcttttagtatttatagagagattagtcagttgtccacggcatggaccctgggaagtgttgcctgagtcagtttacactggtgactacagtcttttaaacagcattgtttcagactataactagttttttctaacttggttctctgttgacaatacttaaatgttatatttatttttctatttgagagccttatattttgacttcaaggcattttctattccctttcacaatgaccttcccaggaatcaaagatattgtcaccaccacacattacatttgagttactaaaacagtttataatccaaatagctatttcactttcctttctctggtctaagattatcttactgtaatttgttttttaaatttagagacagggtcttgctatgttgtccaggccagtctcaaactcctgagtagctgaaaatataggcatgtgtcacctcaaccagtttattgtaaaattttaatgtttagagatcttggagatcatcttttatttttagcagtatttatttagttttgcaggtagagaaaatgacagctgtgtagtgctgtggaaattataataattcatatccaagcttgaatgtcagctccacctctttactatagctgtggccttacaaaacctacttcgtttcttgaaacttgtttcttcctctaaaaagatgaggataatatcttgcagggtggctatgaaaattaagacagttcatacagtatctggcacatggaaagttctcaatgttaattacccatttttttctgtttaaggaaatagtctcaatcctataccatgaatgaattatgaaaatagttggaaaggaaacaacagttttaaatgtaaactgtctcagtcttatgctgacatcagctacatttctggtaaagtgatggtgtcatgatacaggttatattaagagttaaaaccagtttccttctggctttccaactgacataataagcaaaacctgcctgggcaaacatagacctatttattggctcacttattattaatgttaaagtagctttggtgctgacttctcctgttcttgttttaaaatttcactgttgtcatttaaaatctgacagaccttcagaagcttcatagaatgcttaatggtttaaatcgtctctagaacatgtgaagtatcttttccaaagtggttttctccatctgtcagtatgttcaaaatcatgtgtatagggccgggtgccggtggctcacgcctgtaatcccagcactttggaggctgaggcgggtggatcacgagatcaagagatcgagaccatcctggctaacatggagaaaccccatctctactaaaaatataaaaatcagctagccatggtggcacgcacctgtagtcccaactactcgggtagtcccaactacttgggaggctgaggcaggagaatcacttgaacccgggagacggaggttgcagtgagccaagatcgcaccactgcactccagcctgggcaacagtgcaagactctgtctcaaaaaaaaaaaaaatcatgtatataggacagaattgcttatattttcacatttactactggatgcctgtttggttttcatagcaatcaacttttggagtttatgggcagtacttaacatatataacctaagtgtggataattatttaaaataaggctattggaagaaaaatctatagggatttctcagttttcacaacaactccctgagcaaagaaaaaataggttggtttgagttgtatttgatgagatttctaatattctatttgaaatgccccctagtaagcactagtgataggtattaatgagctgaatttgatttccagttccaactctgtcccttgcaacttctgtaaccttgaaggtttctctacgtttcagtttcttcatatgtaaaagagattaccaatatttccctcccaaggctgctgtaacagtgaagtgttgaggtttttatttatttattatttatttatttatttatttatttatttatttatttatttgagacagagtcttgctctgtcgcccaggctggagtgcagtggcatggtctcggctcactgcaagctccgcctcccaggttcatgccattctcctgcctcagcctcccaagtagctgggaatacaggcgcccgccaccacgcccggctgattttttctatttttagtagagatggggtttcaccgtgttagctaggatggtctcgatctcctgacctcgtgatctgcctgcctaggcctcccaaagtgctgggattacaggtgtgaaccactgcacccggctgtgttgaagtttttaatatagccagcacagcatgtggcacatagtaggcacacagccattgcatgtttcttccagacatctcactgcatttttcagtaatattcttttcaagtacgttcttctttctcattccttaacatttaaaagctgtattcaagagagaatattaatgtttgccaagtaaactgaaaatatttcctttgcagcccacacttaagagtgttttaggccgggcgcggtggctcatgtctgtaatcccagcgctttgggaggccgaggtgggcggatcacctgaggtcaggagttcgagaccagcctcagtatggagaaaccctgtctctactaaaaatacaaaattagccgggtgtggtggtgcatacctgtaatcccagctacttgggaggctgaggcaggagaattgcttgaacccgggaggcagaggttgcagtgagctgagattgcgccattgcactccagcctgggcaacaagagcgaaactctgtctcaaaaaaaaaaaaaaaagagtgttttagcaaaaaatgattttatgtatgacataccttggtttaaatcctggctttttaattttaattttttattttttgagacagggtcttactctgtggctgaggctggggtgcagtgatgtgatctctgctcactgcaacctccgcctcccaggctcaggtgattctcccacctgagccacctgagtagctgggagtagaggtgtgctccactatgcctagctaatttttctatttttagtagagacagagtttcaccatgttgcccaggctggtctcaaactcctgggcttaagctatccaccagcctcggcctcacagtgttgggattacagttgagagccaccaagcccggcctgaatcctggcttttgaatgtaatagtgttgtgaccttaggcaagctacttaacctatccctaaagtattatgaggctaaagtgagtaatagtatgtataaaacatctagttcattgtctggtttgtatattcccaaaataaatgttattattttaagtggaaactgttgtttaatttgataattcatataattcatggcttttgagagcctgctctactcaaagcccgttaagagcaggcaggaacattgtgaacgaatgttgggcatattattatgcaagtgactgaatttggccttgcctgtaatcaggttcagcaaaagtggtattttctttctttctttctttcttttttttttttaaattgagacagtctcgtcctgatggccagactggagtgcagtggtgtgatctcggctcactgcatcctctgcctcctaggttcaagcgattcttccacctcagcctcccaaggagctgggatcacaggtatatgtcaccatgcctggctaatttttgtattttttgtagagatggggtttcgccatgttggccaggctggtcttgaactcctgacctccagtgatctgcctgcctcggtctcccaaagttctgggattacaggcgtgagccactgaacctggccaaaagtggtattttctattgcatttgaggtaacagaaattgatgggcttgttattgcatttggcgtggcttttttttttttccatgttgtctttctccactgactgtcaaaaaaaaaaaaaaaaaaaaggctacattcatgagtgccacaagagagatttatgattcccaagtgctacagcagaccaaggtatattttggtatctaaaaagtttttcatcttttgctgatcttgtttattagaaataaagatgttactctcctgtattaaaatttaacacaatattggcaagctaaatttaatcaaatattctgcccattttaaaattcacttcctagcctgtccatccttccttttattttgttgtttgattttgttttattgtatgcttttagcagcctgaagccatggtttttagtttctgtctgtagtgataagtggaaaggagggatgaggaaggggctttactggcccaaccagaaatagaaactaagaacccaggactgtattatctcccttggacacccaacactatataaaattgattcctgccctggcagactaagcattggaaagctggtgctaagagtgttatgagaattcctaacaaatagaaaagctcaaggattgacactatagtaaaagatttcattttgacatgtttataatttacttatcaagttaacaataaggtgtttttatttatttatttttgtttatttttattttatgttttgagacggagtctcgctctgttgcccaggctggagtgcagtggcttgatcttggctcactgcaagctctgcctcccgggttcacgccattctcctgcctcagcctcccgagtagctgggactacaggcacctgccaccacgcttggctaattttttgtatttttagtaaagacggggtttcaccatgttagccaggatggtctcaaactcctgaacttgtgatccacccgccttggcctcccaaagtactgggattacaggcgtgagccactgcacctggcctttttttggtatttttagtagagacggagtttcaccatgttggctaggctggtctcgaattcctgacctcaaggcctgccttggcctcccaaaatgctgagattacaggcatgagtcccagtaagatttttaaagggataccaaaataatcaacatttattttagaaggtgactttcttcaatgagatgtcaatgtctactttctgttatatagtgctatggtttcttttttcttttttttctaagtgagggtctcactctatcacccaggctggagtacagtggcatgatctcgggtcactgcaaccttcacctcccaggttcaagcaattctttcacctcagcctccagggtagctggaactacaggtgtgcatgcctcgctaagttttgcatttttagcagttgttggccaggctggtgtactgtttcttttattgactgagatctatatttacacagcatgaaagtctcagttgcattaagtacattcgcattgttatgcaaccatcaccattatctagttccagaattttgccgtcaccctaatagagcttgtatatatgtccccaccaaatcttatgttgaattgtaattcccagtgtttgaggtggggtctggtgagaggtgtttgcgtcatggggcagatccctcatggcatagtgttgtcctcgcagtagtgagttagttctcacgatctccttactccatccacctgcttctcctaaaactttgaaatacgcttggaattgaaagtgtttagtttagtttgaggatagttatctaaaagtgacatacagggctcctgctttgctcttccttagtaaatttcctattttattacacagtttactaatacagaggacttgagttttgttatttccatggaaaacattattgaatctaaatttaactagagatgtgtagttcagggagggagagtggttttataatatgaatcttggatttgaaatgaacttaaagcaaatgaataaaaattgtttcattaattataatgtctgaaataatgcatgtttttgtgaataaaaattgatataataaagtttaaagtgacaggagtagatataactaattgtatttataatttcttggaagtaaaataacatttttgaaaaatattatacaatgacctcacatacagtgacctcacttaatctatgtgaggctatacacagtggctcatgcctgtaatcccagcactttgggaggctgaggcaggtgattgcttgagcccaggggcttaagaccagcctgggaaacatggtgagaccctgtctctacaaaaaatacaaaaatcagctgggcatggtgaggcgcacctttggtcccaactacttgggatgctgaggcaggaggatcacttgagcccaggaggttgaggcagcagtgagctgtgatcgcaccactgcactccagcctgggtaacagaatgagaccctatctcaaaaaaaagaaaaaagtctatgtggaagacaccgcgttaattgtgttgggtggtttagagatgtttctgtctccttcactgatgaccgtgtgtctctgctgctgtcgctcactggtgattatcaactcaacctcttatatttgttttaacaaatatttatacaccctttgtaaatttgcgtgagataaagtcattatagttaaaaaaaattttttttttttttgagacagaatcttgctccattgactaggctgagtgcaatgacatcatcatggctcacggcagcctgaacctcctgggctcaattgatcctcctgcctcagcctcctgagtagctgaaactacaggtgcatgccaccatgcccagcttgttttttattttttgtaaagacagggtctcactatgttggcaggctggtctctaactcctgggttcaggtgatcctcctgcctcggcctcccaaagtgttaggatttcaggtgtgagccaccatgcctgtcctatgaagtcattacaaagaaataaaattaattggtttcattggcagtattgaatttcaaagcagaaggggtgcttaagagaaataatgcctttggagtgatttctgatgctagatgaaactcatatctcatttaaggtgtccatctgaattttatgtttggatgattgtgaattattccttaaagcttgaagtgaactctggctctctaggataaattaatctttattcctttaatctttattcccttagggatatattaaagggatcaaatttttttttagagtaatgtaaaattaagggacttcttttgttaggtgaatttctcaggttttaagatatcagtatcattgtggacattgactacattgtctactaaattctgtaattttaacttataattctcagtaattggctgggtgcggtggctgacgcctgtaatcctagcactctgggaggccaaggcagcagatcacctgaggtcaggagttggagaccagcctggccaacagggtgaaaccccgtctctactaaaaatacaaaaaaatgagccgggcgtggtggcgggtgcctgtcatcccagctactggggaggctgaggcaggagaattgcttgaacccaagaggtggaggttgcagtgagttgagaatgtgccattgcactccagcctgggtgacaagagtgaaactccatttcaaaaataaataaataaataataaaaataaaaatacaaaaattagctgggtgtggtggcgggtgcctgtaatcccaactactcgggaggctgaggcaggagaatcgcttgaactcgggaggcggaggttgcaatgagccgagatcacgccactgcactccagcctgggctacaagagtgagactctgtctcaaaataataataataataataataattctcagtaatttttgcaatttttttggtacctaaaataatttctgttattgtgttggataactttgtcaacttcactttgggaatatctaaatacaggtagctgcattcgagccagaggaatattgggtttttttgttgttgcttatttttgaggcagccttactttgtcacccagactggagtacattggcacaatcatggctcactgcagccttgaccttctgggctcgtgtgatcctcccaacccagcctcccaagtagttgggactaaaggtgtgcaccaccatgcctggctaatttttaaatttttttgtagggatggaattttgctatgtcacctaggctggtttcaaactcctaggctcaagcagtcctcccaccttggcctcccaaagtgctgggattacaggtatgagccaccacacccagttgagaaatactgggttttaatcaagattattgtctgaatattgagtcttaatgacttttttgattttgtttttttggccatagtattaagtttgcagttgataaccttctgtactaactagaagtagtatagaaactgcaaattaaaaaaaaaaacccaggtaaaatgttgatggctgctatttttatttaaggtattaataaaggaaaagaagtcagggacattatggaggtcaagttttatattattaaaactcaacttcatgatttatacatacttagaaatagtctgagtgatgtgtgaccaaaatatgatttctaggaggaatgattgttacatccgtggaatagctgcgtacactttattgttcttggtgcttaaactttagttgtcctgctaagataaaggaagacattctttcagttggaaatcatgataatgtatttctccattgaaacagtatggtttgaacagtgctatatattcatactcattattattccttaaatgaatattttaagctcctgatagaaggcaggtactgtgttatatgctgtttgtgttaccagaatacaaagatgaagagaacaaagtattacacaattcctaatctcacataaatgctattttttttttactagctgtggggagcacaaaataagtggttgaaagtcatctgacacagttacatttattcctttccttttccatggctcttaggaataaattgttctactctatggattaaattgccctttgtttattgcctgggatcccaactttatttcataattttatttctttgaggaaacgtttcacaagttttataacaaagtataactcaatttggagagcacaatctgtgcataagttggaggctacctattgtgaaatggaaaaatgcttgtcctagcattactgagttaatgtatagctggtagaaagttttcactcttaattgctaacttgcctagtgagagtgaaagattgattacggcaactaaaaagtataaaaactactgagtagtttttaggtacagtcagttcttcagtagaacaagaatctttagaaataactttcactaattctttactagttgtttttcctatttctcttggatatggatcatcagaatgttttttgtccctcttacccgccccccccatcccccaccccccgcctcccacttttttgttgggaggcttatgtgagagcattagaggccttgaatgtttgggtagacaaggtaagtattcaaataaacgtttcaagatcattgtgacagtgaaattatttgatatgaaaaaggatctcagttattagaaaaaacacaactgtgttaatactgacagccagcgttgctataagtgttttatgtgcattatctcacttaagctttacaacagtcctaagagaggaatgctgtggttattacacccacttgacagaccagggagcagaagcacagaaacccaaggatttctgctgtcaatgtcatgcatttggctggagttatgatgtcgtgcaagtaatgttccttctttttccctctaattcatttttatgtttttcttttacagggcaattttgtaagatttagtttccaggggtcaggtttgtttgggctttatgtccttgggaaatcctcagtaccttatttcccatattccatactttttaatcttaattttttttcccctcaaatgttatacagtttaatgagtcaagtggtctttcagggattcttaaaacaaacagtaattctcagcctccaccttcatttcctcttctcataggtaaccatcctcaactcataggtatttggaatttacctgcggtttttcaagaaacatttaaaaaattgatttacttgaattttcaggttagaacataaattatttgcatgatttgctgtgtccttgtgactaactcaacctaaacattctatcagttgtccaaatttcccattttctttcaaatttcccatttccttcacttactttgtcagtttcatcatcttgaagaagacttttccagagcacagtgctccaacatggagtagtctctgttttctcatagtgcccagcaatcatccttggaattctcttttcttttctcctgcattggcacttctgtttcttctcctcttatgtcttcctgtttcatgggaggcaaatatttgataccttatgttttctgaaaacactttattttcctctcacccttcattagtggtttcactgtatgtaacattgagattgatgattttgctccattgtcttctagcttgtgttatgcctgttgaaagtacaaaatcattctggaagtttatctattgttagccatttccctcttctggaagcttgtaggatcttccctttgtttccactgttctgaaacttgtaaatgatacgctttaatatggttgtactgtattttaaacaattatgctctgcactcagtgtttttttgttgttgtttttgttttttaatttttaaatttatttatatatttttaaatttattgtttttgtttgttttttgagacagaatcccactctcgcccaggctggagtgcagtggcatgatcttggcgcactgcaacaacctccgcctcctgggttcaggtgattctggtgcctcagcctacccagtagctggaattacaggtgtgcatcaccacgccaagccaatttttgtttttttgttttgttttgttttgtttttttgagatagagtatcactctgttgcccaggctggagtgcagtggtgcgatctcggttcactgtaacctccgcctactgggttcaagccattctcatgcctcagcttcccgagtagctgagattacaggtgtaccaccacgactggctaatttttttgtatttttagtagagacagggtttcaccatgttgggcaggttggtcttgaactcctgacctcaaatgatccactcacttcggcctcccaaagtgctgggattatgggcgtgagccaccgtgcctggcttcactcagtgttttcagttacgaaacttacattgtttagttttgggacattttcttgaattatttcactggttttttttcctctctgttttctcctgtggattccccattgcatagatgctgaattatcttgactggacctccagttttttcttcttgattctgttgccatctctttgattccttattctttctgataaattttcctaagtttaatttccgagagctctttggaaaagtatcgattttttttcatggatggagtatctactcttttgacacagggtcttgctctgtcgtggctcactacagctttgattgctcaggctcaagcgatcctcctgccctagccctcccagtagctggtactacaggcctgcaccgccaaacctagctaacttttttgatttttagtagacaaggtctcgctgtgttgcccagactggtctcgaactcttaagcgccaagcatttctcttgcctcagcctcctaaaattctgggattacagtgtagtatcttctgtattctttccatggacgctaatgatggggtataaaattccttttatttatttattttttattgacatcagaaattcctgctaataaaattctttttaaattttaagtttttttcttcccacagttgtccgtgtttcctccaagttccttttctattttttgttttcctttgttttctttttgtggtagatgctttcctcagatgagtggtaatccttggctgtttgcagttatgcctctaaaagctgattggaagctcttagtacctcattggtacttgttgactagagttcactctagggtgatctatctgtgtcatttgctggggcacccttcatgtcagcttctgattacttttcccttttctgaaaagggagagaggtcttttaatttcctgtctggtgggaggaggtctgtatgccacttctgtgagagagtgagggaagtagggcagtgaggatttcagtattcagtacatatgtgttttcttaaggcctctgttttcattaagcctcccccgcaccaatgtgctttatgtttccctgctctgaaatcctcctgagggaataatcctctagaattttgccttggtgggaaaagcatagtaacctaaccatgtggtatttaggaaggtactgagagattgagcgtttcctaaggagctttcagccagccttctttatttagtgctcccttcacacctgtttctacaggcgctatctgttaccagttcctgagccttttgaagattccgtggacgaaggttggtttttggctttccatactgctggtttcttggatctgctatgtcagttaccatttatgcatttgctttctagcttttaagttttgtttatgccttaaaaatacctgatgagggccaggcgtggtggctcaggcctgtaatcccagaactttgggaggtcgaggcaggtagactccttgcatctgggagtttgagagaagcctgggcaacatagcaaaaccccgtctctactatagaaaaattaacccggtgtggtggtgcacgcctgtggtcccagctacttgggaggctgaggtgggaggatcgcatgagcctgggatgtggaggttgcagcgtgctgagatcatgtcactgtactccatcctgggtgacagaatgagaccctatctcaaaaacaaaaacaaaaaaaccccaaaaaccttattagtattttagcacaatttggggaagaaatgaagttaaatatatgtatgttccatcttctctttacccagaacttatttctaattttttttttgttaagcatcttttttgttgtggtaaaatatacataaaatttattatttataagtatacagttcagtgacattaagtacattcacaatgttttacagccatcactactttctagttctagaacttttctatcacaccaaaaagaaaccccatacccattaagcagtcactccccattccctccctcccccagcccctggaagccacgaatgtgctttttgtttctatggatttgccttttgtggatatttcatataaatgaagtcattcagtatgtggccttttgtcacatgttttcatttaccataatatttttgtggttcatctatggtatagcatagatcactgcttccttcttttttatggctcaataattttcattgtgtggatatatcacattttgtttatctgttcatcagttgatgaacttttgggttgtttctgctttttctggctattgtaaatagtgctgttatgaacactgatgtacaatttttgggggtgaacatttgtttttattcttttaggtatatagctcggtgtggaattgctggatcatatatggtaattctgtctttaacttaatgaggaactgccaatctgttttcctcagtgactgtaccattttatattcctattagcaatacacaagtgtcccaatttctccacatttttgccaacactgttttccattaaaaactttttattatagtcattctagtgggtgtaaagtggtatctttttgttttgatttgcatttccccagtaactaatgacattgagccttttttcatgtgcttgttggccatttgtatatcttctttggagaaatgtctgtttaagtcctttgcccactttaaattgtgttgtctttgtgttgtagagttgtaagagttctttatacattctgggtactagacatgattttcaaatttagatacatgattttcaaatcttttgcctctagatgttttttacttttttatttttgatccttgaactcatctatattctatggttgtgatgtaatgatgacagaattggtgtcatttgtgtttatttaccaggttatttggaaggattatattttaggtgctctcctctcccccagtaaatggtattacgacacaagggttataaaggactgataagaaattacttaagacagaaagggaagttggcctgcttccaaaatgtggtcccagcagaagtgaagttagttacaccaataaccacagtcaaaaagctatttttaaccatgataatgtatttgttgttattaatattaaagattatattttgccaggtgcagtggctcacatctataatcccagcactttgggaggctcaggcggatggatcacttgagctcaggagtttgagaccagccagggcaacatggtgaaaccccatctctacaaaaaatgaaaaattaaccgggcttggtggtgcgtgcctgtagtcctagctacttgcgagtctgaggtgggaggatagcttgagcccaggaggtcaaggctgtggtgagccgagatcgtagcactgcactccagcctgggcaacaggacaagaccctgtctcaaaaacaaaacaaaacaaaacaaaacaaaacaaaaccgactatatttctgcattaagtgggggtttggaatcctatctaatatttgagataataattgttatagtattttattgagcttttattgggtaccagatgtgttctaagtttttttcgtgaattattttcattaatcttattcattgttgtgtcctgaatgagtactcacatatttgttgaagggctcaatggtccctaaaaccttagatgctgttttggaaggttaacttgccaaaggtcacatagttggcaaatgatgaagctgagattaacattaagatctgattccaaagtagtctttcttaactatattgctttatgtggagttttgccattgatgtctagacagaaaatctctagcaatggaaaaaaataatttttaattaattttaatttttttagtgttttgcttctttttttttttattttgtgagccaccgtgcccaattggtttcttttaaaagaccagttagtttgtgcattaggcctcttgattaatctgaggtatttaattaatatctttgaaatccttagatttactgtatcacttctgcaatatctaaatttttccttcttacttatttctgttctccttctacagtcctttctattatgtttaatcatcaaaacgttgttcttgttttctattgcaatctaatttttagtgttatgctgtttccagatgccatttgggtcattttcaaaaaaagatgagtaataattagcaagtaatgaatattgttctttttaccattcattaagaacaattgttaattgtcttattctattgtgaagaatatctgtaattcctgcttagaacctgggttgatagcaggatatcaggaagcactaagtgtacacagaacgatatagctggaaaaagtatatatgttaaagaataatatgttgtctaaggatgatcacacaggttcttttttggtaagcttcaaaacttcttatctcccatgaaagtactttttcttttataatatgcaacaataactttctgtttagttaattagttttaaaacaagcttaaacttataatttataaagaatcatatttgctccctatcattgttttatagctggggctatactgacaaataagaaaaataaaattcctgcccttgtggaggagacagttaaaaaatgggacaaatacatttcagatggaaatgaggacaatggaagaagagtagagcaggatgaaggcatgaagggtgactgagatctggtcaatctttagatagtgtaatacgggaaactgctttgaaaagatgacttttgagcagagaccttaatgtactgagggagtgaaccattcgaggtctggggaaagaattcagcttcctcttcagatgtacaaaattacaagatattgccattcttgtaactgaaaacctataaaagcaggataagaagtacggtttctaaaaacccatcgaagagctgaggatacaagggagcctaaatgaaccaaactccagaaagtaatcaaactttcatagtggagaagaaacccatggttgctctaggatggaacaacgaaaggaataggaatccaccatagatgaggggaaaggagaaaccagccacatttttttaaaatcagatttttaatggccacgtatgggctggtttgacaggttaggatcctaagaagccctagcaactctggcaccaaagagcaagtatgcacccacactccagctcctacccacagatgttcactgaatgttcaggagtagtaagccaaaagcctgggccagtgacgaactggcatagataatacctgaggcatttggaacctctcccaagtatagggcaaccacccttagaaggcaggattgctgagaaaaatccagcagaggctctccaggctttcagttctggaatgctgcaggcaggggaagagctagaaataactctcaccccacactctggcagtccatgttttcagccaccaaggactggggacagggcagaagaggtgagtgaaactgctctaattcatttcaggccttcacagaatgtaaggaagctgccctccagaagcctggctggggaggaggagcagggctgcacgagggcacctgagcttcagaaagcaaggtgtgcgactggagagcaaggagaatctagcaaaccaaactctgaccgtggcgcttaatgcagagatagagttcctacagcttttttttctttcttttttaaaatataaacttgaatttttgaaacagtttcagatttaaagaaaaattgccaagatagtatagagagttcccataatgctgcctctagtttttcctatttttatttaatttatttatttttttagtttttcctatttttaacaccttatattagtatggtatatttgttataattaatgaactaatactgatatattttcattaactaaagtccatactttatttacctaatgttttgggatcccatttagctgtcacgtctccttagggtcctcttggttttggcattttcttagacttgagcttctcatctcttgtttttgatgactgacagttttgaggagtattgttcaggtattttgtagaatgtcattctattgatatctgtttggtatttttgtcattgttacagtgaggttttgtatttttgggacgaagaacatgcaggtgaagtacaatttgctttcctttttttgagacagtgtctcactctgtcacccaggctggagtgcagtggtatgatgacagctcactgcagccttgaactcctgggctcacatgatcctccctccttagcttcctgagtagctgggactacagatgcatgccaccacacctggctaatttttttttttttaatagagacagagtctcactgtattgcctaggctggtcttgaactcctaggctcatgcaatcctcccacttcagcctcccaagtagttgggactacagacatgtgccactatgcttggcagtaccattttcatcacatcatattaaggggatatactgtcaatatgactaatcagtgttgatattgaccttgatcatctggttgaggtagtgtttgtgtatttctttactacaaagttactcttttttctcctctgtttacatactgtactctttggaaggaagttacatatgcgcagcctacacttaaggcatggggagttatgatacccctcctcaagggcaaagtgtctgtataaattatttagatttcttctgcatggaagatttgtctcttcttcctcatttatttatccattcaatttttaaaatattagtatggacttatggatattttataccttgggttaaaatcttattattgctttatttattttattgttcaagttgttccagctttggccactgggagctctttcagttggtatgactttttgatataccactgtcagtatatgtgtgtatgtgtgtttgcactttctcactttctggcactacaagatgctctagtatatttagagactaaagcatgtagtatatgctttagtatatgctttatctagtatatttttctgtctcaatcctagaattagccatttctccatggagccttggttccttttactggagaatggagaaaccaagatctaggtgctaggtgtacatgttgctactggggtgtttttgcttgtaggccatctcagctgacagagccagaaaatgtatgtatttatactaccctgtatatatccacatatctataaatatttctatatgtatccatccgtatctaattaagctaaacatgagtttatattgatgtattaggttccagttgaatcactacatggatgattctaacttcctgcccttgcttatctgaaaactcctgctccaatagtgagaaatctgtctcctaccatcagccacccatttacttaatcattctactctagtatacatgtaaggtactcccacagttttaaaaattggtggcttggctatgaaacacaagcaggtctctgtaattttacctaggctcagatcccagacctgctcaagtgaaaggcttgatctcagtccttaaatatttgaagccagtgattaatgttaaattaaagctgcatcatagcccacacccagctcagttacatattggattgactcagactcccttctagtgtcctaacagaaaaattgtcatgtctttttctggaagtaaaatattacttaatttaataagtaatctatttttatataaaatgtctggtgtgtaatgaaaagttacaaggcacaagaaaagcaagaaaatgtgaccaaaggtcaagagaagaaatagtcagtagaagaagacccagagatgatccagatttatcagacagggatttaaagataattatgaaaaaaatgctagatgattgaatgataaaggttaacaatatgcttgaaaagatggggatttctgtagagtcatggaaattatgccaaagaaccaagttgaaattctattaaatagaggtgaaaaatatactagcagagaccagggaaaacaaaaaaaggaaagaaaagaaaaggaaagggaagggaggggagggaagggagaaagaaaaatatactagcagaaatgaattcattacatgggcttaacagtttatggacatagcagaagaaagaatcagtgaatatgaagacagattggaaagagaaaagacagaaaaagtcagggaggggtagaaaagagattttagatctgtgggataatatcagatggtctaacatatatgtaattggagtttcagaaggagagaagagaacgtggcagaagacatatttgaagagacaatgctcaggaacttctaaaattgatgaggtcatcaattcacaaatggaaggagttcagcaaatcccaagcaagttaaatacaaaacaaaaataagccaacaaatttaaaaatcccatatataggcatatcataatcaaactgctgaaaactgaagatggaagagatcttacaagcaacaggagagcaacaggagaataaaagacacattagttatgtgagaatggcaacatgggttatggctattccatgttttaggaccagaaaaaaatggagtcttagctgagcatggtggcacatgcttgaacccaggagtttgagtccagcctgagtaaagtagtgagaccccatctctatttaaaaaagaaaagaagtccaggcacggtggctcacacctgtaatctcagaactttgggaggtgggcaaatcacaaggtcaagaggtcgagaccatcctggccaacatggtgaaactgcgtctctactaaaaatacaaaaattagccgggtgtggtggtgcacacctgtagtcccagctactcgggaggctgaggcaggagaatcacttgaacccaggaggtggaggttgcactgagccgagatcatgtgccactgcactccagcctgtcgacagagcgagactcagtctcaaaaacaaagaaagaaaagaaaaggaaaaatagaatgttaaatacaatgggatgacatccataaagagctgaaagaaaaaaaaaaaaaacaacctgttaacctagatttctatggccagcagaaatagccttcaaaaataatggcaaaataaagactttttggacatatcaaaaagggaaagaatttgtttccagcagacctggactcaaaaaacattaaaacatacacattaacaagatgtgggttttacagcatatatgtgattatacaaccatgaaagaacaaaaaggaggagatggaattatactgtcatacatttcttactctgtgaaaggagactgtagtaacttctggatgcatatgtaatctctagaacaagcactaaaaacacaaacagggataccataaagtcagtacatctgcccaagagggattaaccgctacgagaatcattctcctactgtaaacagctagaaaacaggacaaaaatacatgaaacaactgttttcagacattggacaacaggcagcacaggatagtgatccctgagagaagggaaataactgatatgaaccctacaggggttcctataggcagtttccagattgtagcacagagtaggggaatccaaatagagcccaggagagtttggagaagtcaaggcaactagaatttgtggggcagaaaacaagaataaaaggaactacacagaaatctatagaagtaagagaatctttgattggacactcatctgcacatgtgaagtgtggaagtcagcaatgctggagaaagtcacactggaaatcagaacactgaacaattccaggagctcacacagagctgggaatagtttatgtttccattaggcatagtggagagactgtttcatacaaaggacattggctagagtcttcaaagtggggttaaattagctatagactaaaggcctttctaaacctaccctaagcttcaaggcaggttttgaaaggaccaggctgattctaagtaactcaattatgtgccaaaactaaactcttttaaagaatacagtaaatgccagcacctaacaattaaaatgttcagcattaataatatattaatgaaagattactaggcatacaaataaaaagcaggaaaatgacccataaccaggagaaaaatcaatagaaaagagacctagaaatgtggaattattagaaataattctgatgattgaattatcagccaaatatgttaatacaagtattataatgactagtagagaaatgaatgatagataaaaagacacaagccagatgtggtgaatcatgcctacagacttgagggtaggcagatcagcttgcccaacatggcaaaaccctgtctctactaaaaatacaaaaattagctgggtgtggtgggatgtgcctgtaattccagcttgggaggctgaggcacgagaattgcttgaacctgggaggcagaggttgcagtgagctgagaacatgccactgtactccaacctgggtgacggagtgagactttgtcgcaaaaaaaaccaaaagactcacaagtagtatctaaagatgaaaaataccagatataatatccaaaactgggggaaaaactggatgtgattaacagcagattagacactgcggaaaaaaagatcattaaatgtgaaggtatagcagtagaacctattcacattgaagcacaaagagaaaaaaaatactagaacaaagttaatagaacatcagtaaccttgggacaatagcaagttgcctaatacatgtataattggagttccagaaaagtggggaaaggtagaaggaattactttaggaaacagcgtctgggtggccaggtgggtggctcacacttgtaatcctagcactttggggggccgaggggggtgcagatcatttgagatcaggagtttgagaccagcctgtccaacatggtgaaatctcttctctactaaaaatacaaaaattagctgggcttggtggcatgcgactgtaatctcagcttcttgggaggctgaagcatgagaattgcttgagccagggagatgtaggttgcagtaagccaagatcatgccactacactacagcctgggcaacagagtgagaacctatctcaaaaaaaaaaaaaaaaagaaaaagaaaaagaaaaagaaaataagaaaatagtggctcatcatggtggctcatgcctgtaatcccagcactttgagaggctgagatgagaggattttttgagcacaggagttcaagaccagcctgggcaatttccttaaaaaagaaaaagaaacagtgactataaattttccaaatctgatgataaccataaactctcagatccaagaaactcagtgaactctaaatagaataaacaaatataatcatacctaggtatgtaataataaaattagtgccagtcatggtggctcatgcctgtaatcctaacactttgggatgctgaggcccggagtttgagaccagcctgggcaacatagtgatacccctatgtctacaaagattaaaaaatagaaatataaaaagttagctaagcatggtggcacttgtctgtaatcccacttacttgggaggctgaggtgggaggattgcttgaactcacgaggtcaaggctgcggtaagccataattgtattccacccagggtgataaagcatgacgggagatcctgtctcaaaacaaaacaaaaccaaaaaaaggcgaggcacagtgactcacacttgtaatcccagcattttgggaggtcaaggtaggatgatcgcttgagcccagaaattggagacaagcctgggcaacatagtgagaccctgtctctcaaaaaaaagtttaaaaaggcgggcatggtggcatgggcctgtagtcctgtctactcaggtggctaaggtgggaggattgcttgagcttgggaggttgaggctgcagtgaactgtgttcgtgccactgcactccagcatgggagacagagcaagatcctttctcaataataacacataaaccaatgttacaatgagaagaaataaattctggtgttcggttttttgtttttttttttctgagatggagtttctctcttgttgcccacgctggagtgcaatggcatagtcttggctcactgcaacctccacctcctggattcaagatgattcttttccctcagcctcccaagtagctgggattacaggtgcatgccaccacacccagctaattttcgtatttttagtccatcacgttagccaggctggtctcaaactcctgatctcaaattctggtgttctattgcacagtggggtgagtatagttaagagtaaaatattattacaaaatagctggaagaggggcttttgaatgttctttcactaactgctctgattggatcattatgcaacatggatatgtatcaaaacatcgaactgtggcccggcgtggtggctcatgctggtaattccagcactttgggagtctgcggtgggtggatcacctgaggtcaggagttcaagactagcctggccaacatggtgaaaccccatctctactaaaaatacaaaaattagctgggtgtggtggtgcatgcctgtaattccagctactcgggagactgaggcgggagaattgcttgaacctgggaggcagaggttgcagtgagctgagattgcgccatcgcactccagcctgggcaacagagcaagactccatctcaaaaaaaaaaaaatcaaattgtaccccataagtatgtacaattacaatatgacagtttaaaaaataaattaaaaaaaaattctcttgtacttaccagctgaataaaaaataaatttttaaaaggagagaagtcttcttaaaaaccagttatttaccccatcattaagttataatgaactttcttatgggaattctttgataaggaagctcctttatgctgaagttttattcttttcatacctctttagataaatcagtgctttaggagcatatgtcatatgactcaatggcagtgttctaacttggattctagctccacattgtgcaaaggcaaaaaaccagagagtcagtgtggtagttaagaacttatgttctgctgtttgatttcctacatgccagtactccctccactacctgcagtcttcctgacctggggcaagttccttttgtaaactctgttttctagggggatggtggtggaagaaggatggtgatttgagccaggcagtagcaggtggaggtggagaaaagtggtcaaaccctgaatgaacgttaaagataggaccaaaaggatttgatgagaaattggaagtagagcacggggaaaaagaaagatatcagtgatgatgccaaggtttttggcctggggaattgggatagtggagttgttatttgctgagtatgacttttcacaaaggaatgtcaaggcgtaagtagcaaagttctttttttttttttaatttttcttgattgtgtttgttttgtttttcatcttttgtgggaggtgggtggagatgaaagcaagcacaggggttggcaggcatacccctggcacctacctgtgagttcatgattactagtcttaaagttcagtcctttttatttttactttttttttttttttttttttttttagagacagtgtctcactctgtcatccaggctggagtgcagtggcacaatcacggcttactgtagccttgatctcccaggctcaggtgatcctttcacttcagcctcctgagtagctgggactacaggcacataccaccctacccagcaatttttttaaaaaattttttgtagcgacatagtcttaccatgttgcctagactggtctcgaactactgagctgaagcaacctgtctgcctcagcctcccaaagtaaagtactgtaattacaagcttgagccaccgtgcgtggccaaattctggccttttgatgttgcatggtgtggatggggaggcaaagtgtgatattttaggaatttgaggatttcttcttcgaccttaggcgtgacattggacaaatgacatctgggctgagacattttctagtaatgctggatccaaaaaactcttatcccattgtctcatagcttcattacacagacctggcggccatgatcctcttttttcccccttagttgccaaacatgggttctctgtcttacctcatttgagtcttacctcagtcttgagagtctcaaatgtgtatcatagtttttagacaaaattcaaccttatttcaattagtatttcattgttatttaaatattttaacaggaaaactgagcaatgtttccctttacctgttaatcctgttataatattttagataaagtgtattagaaggcacattcttcattaatagaatatttattcatgtgtttatatggttcttaactaggaataccatatagtctatctccaaccctttgagaaggaaaaaagatcctgactaaacaggacaccagaagggcatgcctaaactaggactgttctgggcaaatcagaaggcatgttcaccttattctttttattctttctttttcttttttttttttttttttgtgacggagtctcgctctgtcgcccaggctggagtacagtgacgcgatcttggctcactgcaacctccacctcccgggttcaagcgattctcctgcctcagcctcctgagtagctgggactacaggcacatgccaccatgcctggcaaattttttgtgtttttagtagagacgggggttttgtcgtgttagccaggatggtcttgaactcctgacctcatgacctgcccacttcggcctcccaaagtgctgggattacaggcatgacccactgcacctggcctcaccctattcctaaggccagaaaaccagctagagtaaagttcactttctgtttgagtgcttggactttattgggagaaggcaaatgccctggaacaagagtgaaagggagaaattcccgttgtattgcaagccagaataagagaggctcacccacactggcctaaggcatctcagttgttgatgagaatgtgattacagatgtctcacttgaataccaaagacaattgcaaaggaaattaaaagttatgcaaagagagtcgagaagtcagttgtctgctcacaggttggctttagtggctattactttgagatactaaatgagcgatagctttaaacttcaactgcttttgtttctgaggaaaaaaatcatcttatatcttttcataagttgcataaaaagtggacattttctattattttaaagagtaaatttaggtacaagcatttactaatttttttttttttttttttttttgagatggagtctcgctttgttgcccaggctggagtgcagtggcgcaatcttggctcactgcaagctccgcctccctggttcacgccatgctcctgcctcagcctccagagtagctgggactacaggcgcccgccaccacgcccagctaattttttgtatttttagtagagacggggtttcacccttttagccaggatggcctcgatctcctgacttcgtgatctgcccgcctcagcctcccagcatttagtaattcttaaaagagttcagcatgaatatacacagtacgtgggttattagtactgtgttgttaacacaaatgaactatgatagcaaattgaatttggttcaatcaggtcaaagaataaaaggatgactttctttaaccaccagcaaaggatagtataatgaaccccatgcaactatcacttaacttcaataatttcaagtttgagtaagttgcagagtagtaatttgaacccacatctctcttgttccaaatcccttgcttttaattacaatcccatgtggcttctttgtcatttgatgctattgagcaactttatgatttttttggtgtttttggtaaaatagacatgaaaaggcattactacagggagttttttcactccctggtaataagaggggaaaagcactctcttttaatgatacatgttttgtaataagcatttttttttagttgcagtgttctgcaaagacaaaacctgctgatacaattcatcctgttttagaaatctttgacccattcatcagactctgaccactctaaagataaaggattatggttgtattggtttttccgactgaagcggccttctgcagattgagaaattgtataattattaactgcggtaatggagatgtacttgcaagtttcatctggtatcttaatgacctttaaccctctgagtacacctaaaacatatcctagaattattgaaattaatcagttgtccataacttttctgtctgtataatttggctatcatacatattttgtttccccctgcccttgccagtttccatcctcctactcacatactcacaactcctataaattggagtatttagtagcagtagcctttgatataaacactttttaaaaatttactattttttgaattaatagggccactttctagtcaagtttttttttggggggggggtgaggagggtagggtaacagttctacacttacaagggtatttgtttagaccaagcttgttcaacccacagcctgtggggctgcatgtggtccaggatggctttaaatgcaacccaacatgagtttgtaaactttcttaaaacattatgagttttttttgagattttttttgagacagagtctcgctctgttgtccaggctggagggcagtggcccgatcttggctcactgcaacttccacctcctgggttcaagcgattctcctgcctcagcctctggcgtagctgggattacaggtgtgtgccaccactccaagctaatttttgtatttttagtagagacggggttttaccatgttggccaggctggtctcaaactcctgacctcaagtgatctgcccacctcggcctcccaaagtgctgggattataagcatgagccaccgcgcccagcctgcgattgttttttttaagctcattagctatcattagtgttaactgtattttatgtgtggcccaagacaattctccttcttccgttgtggcccagggaagccaaaagattagacacccctgatttagacaaataagtgaaggcacactgaaataacagttatatataataaccttgtgccacccagcgcggtggctcatgcctctaatctcagcactttgggaggctgaggcgggcggatcagctgaggttgggagttcaagaccagcctgacttacatggagaaatcccatctctactaaaaatacaaaattagctgggcatggtggtgcatgcctgtaatctcagctacttgggaggctgaggtaggagaatcgcttgaacccaggaggcagaggttgcagtgagctgagattgtgccattgcactccagcctgggtgacaaaagcgagaatctgtctcaaaaaaaaaaaaaaagaaaaagaaaaaaaaacacaaaaaaaccttgtgttttgtggatctcacattcatctcagatatttcttgccctgggagatcctctgaattctcaggactgcttcgtgtcatccctttatgctctactatcttcccctgcctagaaggcaagtagggctttgaatctcacctttgattctactgtgatcctatcaaatatagtaatgctagaaatataggtctgaagtttgggagagagattggctcggtatagatatgtaaagcacagttgtatatgtggtagttatatgaatgggattggatgaaattctctagaggtgtgtggaatggaaagaggtggcccaaggaggaagagagagagagagaaattggagaggtagaacaatttaggaaagagtaatgttctagaaactaaggagagagtttcacaactgcagtggtgaagcactgtgagttcttatttggcaatttggacttcattattgtcttatcacagataggaaatgaaaggttgcagaacatttaggagaaaatattaagtgaggacacagaagcagtaaatgtcgtatatgccttttaaacattttggagattacccatagtaggcctgtcccttgggtaaggcaattagggcagctttcctgggccctattttggggtggggaatgactcggggactttattatatgactttttttctgaacattaataaaattcagtttcaaaattttgtgattaactgtagtcctaagagcctacgaaaaatgcagataatgggcagttccacattggttgaactgccccaggcttctctcttctagagatgctgtcccttccttttaatcctgtagtagctcctatcactttttttttttttttttttttgagacagagtcacccagactggagtgcagtggtgtgatctcagctcactgcaacttctgcctcctgggttcaagcgattctcatgcctcagcctcctgagtagctgggattacaggtgcgtgccaccatacctggctaattttcgtatttttatgggattttaccatgttgcctaggctaggcttgaactcctgacctcaggtgatccacctgcctcagcctcccgaagtcctgggattacaggcgtgagccaaggctcctggcctcctgtcactttttataattgtcagtttgtttttcctctcagaaattaagctccttaaagctctctattattgttttgaattcccagggcctagcataatgcccagcacgtaatgtttagtgtttgttacgtgagtgattgaaggaataatccaatacatatctgtcttaagtacaaaagaattccaatatggtggtctcacagagtcaaaaaagcggaatgtttcagaaaagagggattgataaacagtttcaaatggtactaaaagtattgaaaactgacctttggatttggcttctagaaggtcattggcttccatagtgaaaacttttataacaaaatggttggagtagaagtggttgaagattaaaggagaaatgagatgtaagaaacaacaaacaagtttgtgggggcgggggggttggttttatttttaaagatttgtagctgagcatgacagtatgtatctgtagtcccagctatttgggaggctgtggctggatgacagcttgagcccagcagcttgaggctgcagtgagccatgattgcaccattgcactccagcctgggtgagagagagagaccctaactcaaaaaataaaataaaataaaataaaataaaataaaataaagatttgaagctaaagggaagaaaccattggagaagaaagccaaagatctgatggaggagaattcattatcatggtaatgttatgcatttgatttgcatatatctaagtattcccaccaacattttttttttttttttgagacagagtctcactctgtcacccaggctggagtgctggagtgcagtggcacgatcttggctcactgcaacctcctgggttcaagcgattctcctgcctcagcctccctagtagctgagactacaggctggtgccatcacgccctggtgatttttgtgtttttagtagagatgaagtttcgccatgttggccaggctggtctcggactcctgatctcaggtgatcctcccgcttcggcctctcaaagtgctgggattacaggcgtgagccaccacgcctggccccaaccaacatttcaagataatatatttctcctcccacttgggtttgacatattaatgtattttgaacttgaaggcttttgctgtgctatttggggcccctagtggtaaatctaataatgacatgcaatagaacagctaatataccagttattccttatgaaggttattctttctatgaggattaaatgaggttggaatatgtagttatagcaatagtagtgattcttaatcatttttttaaaaagagagtctcgccaggcacgttggctcacacctgtaatcccaacactttgggaggccaaggtgggtggatcacttgaggtcaggagtttgcgaccagcctggccaacatggtgacaccccatctctactaaaaaaactaaaattagctgggcgtggtggtagacggctgtaatctcagctactcggtaggttgagacaggagaattgcttgaacctgggagacaggaggttgtagtgagctgagatcgcgtcattgcactccagactgggtgacaagagcaaaactctgtctcaaaataaataaataaagggtctcactttgttactcagactgaagtgcagtggtgtgatcatggctcactgcaatgtccgcctctcaggctcaagtaatcctcccacctcagcctccctagtagctgggactataggtgttccaccactatgtccagctaattttaagaaattttttagtttttaaatttttttgtagagatggtggtcttactatgttgtccaagctggcctcaaactcctggtctcaagtgatcctcccacctcggcctcccaaagtgctgggattaccggtgtgagccaccatggctggccaaaaatgagtaatttttttttttttgagatggagtctcgctttgtcgcccaggctggagtgcagtggtgagatcttggctcactgcaacctcctcctcctgggttcaagcgcttctcttgcctcagactcccgagtaactgagactataggcatgggccatcacagccggctaatttttgtatttttagtagagatggggttttgccatcttggcctggctggtcttgaactcctgacctcaagtgatccacccccttggcctcccaaagtgctgtgattacaggcgtgaaccactgtgctctgccccaaaatgactaatttaaaggtgactgtaatatagttaaacaaatgcctcttttcccattctttactaacttgttatttaaatggggcaagtttttacaacataagaaacaggccaggcgcggtggctcacgcctgtaatcccagcactttgaaaggcagaggcgagtggatttcttgaggtcaggagtttgagaccagcctggccgacatggtgaaaccccgtctctactaaaagtacaaaaattagccgggcatggtggcacagactgtaatcccagctaatcagggggctgaagcaggagaattggttgaacctgggaggtggacgttgcagtgagcctagatggcaacactgcagtccagcctgggcaacagagcaagactccatctcaaatgaaacaaacatactaaaaacctattaacttgtttgatgtgagtgtgcttagctttatttcccttaaagagagtctttttttgagatggagtctcactctgttgcccaggctagagtgcagtggtgcaatctaggctcactgcaacctccgcctcctgggttcaagtgattcttctgcctcagccttcaagtggctgggactacaggcatgtgctaccacgcccagctaattttttgtttttagtatagacggcgtttcacgctgttaggcaggatggtctcgatctcctgacctcgtgatccacctgcctcggcctcccaaagagctgggattacaggtgtgagccactgcgcccggcctaaagagagtctttaggtgaaaaatttttgtgaatattgtgatttctccttaataatttcttgtgtatttatgaatttatataattaaatggcatatcaaaaaaatcacctatgttaattatgtttttgactcagttatattttcttttggtacattattaagttaatatccatatgcaaaaatatgctgacaatatattaattttggatttttcatttttatcagaaatcatgagtggaggatctcaagtccacattttttggggtgctccagttgctccactgaaaatgacagtatcagaagacacagcttctttaatgtctgttgctgacccctggaaaaaaattcagcttttatacagtcaacattctttatatctgaaggatgaaaaacagcacaaaaatcttgaaaactatgaagtcccagattctattggttctccagatctttgtggtcatttcttagcaaactgtatgaatagacatgttcatgtgaaagatgactttgtacgttctgtttctgaaacacagaatatagaatcccagaagattcactcctctagactgagtggcataactagctctaatatgcaaatatgtggatttaaaagcacagttccgcatttaaccgaagaagaaaagtatcaaagcttctcagtgaaaataaaattagagatgaacagcctaaacatcagccagatatatgtggtcagaactttaacacaaatttgtttcagttgggccataaatgtgcagctgtgttggatttggtttgtagtactgaaaaaattaatatagggcctgaagtggtacaaagagagtgtgtgccaacagaatatcatgaaatacaaaaccagcgtttgggattattttcctcgaactcagtagataagtcaaggtctgaagcagcagttaagaaggtctcagaccttaaaatatcaactgataaagaatttctcagtataattacctccagccaggttgctttttttagctcaaaagaaagataaaaggcggagtcctgtaaataaagggaatgtaaacatggagactgaaccaaaggcaagttacggggagataagaatacctgaagagaattcgattcagcttgatggttttacagaagcatatgaaagtggacaaaaccaagcatattcccttgaactttttagtcctgtttgtcctaaaacagaaaatagccgcattcacataaactctgataaaggtcttgaagaacatacaggatctcaagaacttttcagttctgaagatgaactgccaccaaatgagatacgtattgagttgtgtagctcaggaatactgtgttcccaactaaataccttccacaaaagtgctattaaaagaagctgtacctctgaagataaagtggcccagtctgaagctctatctagagtccttcaagtagctaagaaaatgaagttgatttctaatggaggagattctgctgtagaaatggatcggagaaatgtgtctgaatttaagagtattaaaaaaatcattaataaaaaactgtgattctaaaagccagaagtataattgtttagtcatggtgctatctccatgccatgtgaaggaaataaacataaaattcggaccaaattctggctctaaagtgcctttagcaacagttacagtaagtgatcaatcagaaactaagaagaaggtttttctgtggaggactgcagcattttgggcatttacagtgtttcttggagatataattttactcacgggtgaggtcattatggtatagtggtagcttattttataaagctaagttttgtttgtttttgttttctcccacttagtctttgaagactctttctttagtcatttgcctcttctgagctcagcataattgatccctttattgcatctgcattgctctcctttccattgtccactctcctgcccattgccacttctgggcctctgttctatccttctcagctctgccccttctttccacttatcccctcctttaataagccttccctagtcaggtggagtgggtcacacttgtaatcccagcactttgggaggctgaggcaggaagattgcttgaggccaggaatttgagaccagccttggcaacacagaacccgtctctacaaaaaataaattaagttttgcgtgcctgtagtcccagctacccaggaggctgacatgagaggattgcttgagcccaggaggttgaggctgcagtgagctttgattgggccactgcactctagcccaagcaacagagttagacctttctgcttctttacctaatgtctaataatgctgtgcacattgtgtttttactgtgggaacagttattgatttctgttgccttattttattatcaaaattatattaattacacttggaaatatggaaaggaaaaaactggtattataccaacttcatataaccaccaatagagttcgagagtgttgccttccagttattttctctgttctccttaaaatgtgtgtgcatgtgtgtatatatcacacatagaagctcatatttattgggagcttagtttgtgagaccctgttttagattttacatgcatatttcattacaacaagtatatgaggaaggtactgatttttatccccacttttcagttgaggaagctgaagcccagagaagtaaagtaacttgtccaatgtcatacatctaggaagtggcaaagctatagtttctcctagactccagaatttatactcttactatatagttgtaaccataaagaacattttgtttttttaatttttaatttatttatttttaagagacagagtcttgctatgttgccaagtgcagtgggtactcacgggcacaatcccattactgatcagcatgagaatttttgaattgttatttttaattttttgtttgtttgtttaataaggacaggatctcactgcattacccagtctgatctccaactcctgggctcaattgatcctcctgccgcagcctcccaaagtgctaggattacaggcgtgagctaccgtgcccatggtatttttaacatgcccttgtttccaacctggaccagttcacccctccttagggaacctgtggtcctccactcccaggaggtcactatattgatggcaagcttagtgcaaacacctgatcggctacaactctgaactcctgggctcaagtgagcctcctgcctcagtctcccaagtagccaggactacaggcacgcatgccgctgcacccagagagaatatttaatttttttttttttttgagacagtcttgctctgtcacccaggctggagcgcagtggcacaatcttgactcactgcaacctccgcctcctgggtgcaggtgattctcctgcctcagcctcttgagtagctgagattacaggtgcaagccaccatgcctggctaatttttgtatttttagtagagacggggtttcaccatgttggccgggctggtttcgaactcctgtcctcaggtgatccgcccacctcgccctcccaaaatgctaggattacaagtgtgagccaccgtgcctggccagaatatgttttcaccgaagacatctaacattgtgttacgtgttctttgttgatttaaaattgacacatggtgtattagagcaggaggaagttgattaagcttaataaaatatctaaagaaagaatgtgatacagaggcggtatttagaaaaagaaaacttcgaagcaatattgatagtcctaccaaatagtttacaggaggaatgagaaccttagctaatgtaccttggtgttcctgtaggattgtcaagtacaatctttttttttttttttgagacggagtctggctctggcacccaggctagagtgcagtggcgcgatgtctgctcactgcaagctctgcctcccgggttcacgccattttcctgcctcagcctcccgaatagctgggactacaggcgcctgccaccgcgcgcggctaatttttttgtatttttagtagagacagggtttcactgtgttagccaggatggtctcgatatcctcacctcgtgatccgcccgcctcggcctcccaaagtgctgggattacaggcgtgagccaccgcgcccggccgagtacaatcttttataaagaggtaaacacaaaattgtaatgaacaggcttagcatagccacatcccactggcaatattagctaatattatttatatgtgattatattattggaggttcaattcacctaactccctctgttctgattcagtgcttgctgaatacctctttgcttgtgatttggctttctagttgtagagctgcccacagcatgagaacaggctgaaatactgtttttttttgggcaattattgtaaatgaaaaaaaaatgttttttttctttaatttgtttcattaattgatttagtatgagcttatgttgcagagctgaaatctagttttggagtgttaacaaaattaagtttcccagactgtaaaagagggctggatcctggaccatggtcattttaccgaggcaattaatgtcagcagggacctctcaggggccttttccgttttcctaggtaggtgtaaactcaactctgcaatctctgtattttttcctaacatctctatagttgttaacgactaggtaacattctctctggtggctgtaatgcaatttacttaaccattttcctattataagacatttagatgatttctatgaactttttttaaaaaatcagattttttttgtctttttaagaaaaagaggatctagttcaccgaattctgaataagtttcttttgtgtggaacagatggaaatgttgggaaaaaaaagaaatctacacttttctgttgtcctaatgagtcagtgaacttagttggatagcttgggtagttcatactacctattgatatatacccccaaacagaaatcttcctttttttttttttttttttttgagatggagtcttgctctgttgcccaggctggagtgcagtggcgtgatctctgctcactgcaacctctgcctcctgggttcaagtgattctcctgcctcggcctcccaagtagctgggactacaggagcccgccaccacgcctgactaatttttgtatttttagtagaggcagggtttcaccatattggccgggctggtctcgaactcctgaccttgtgatctgcccaccttggcctcccaaagttctgggattacaggcgcgagccaccgcgcccggcccatactgaaaaatttgaagtaacagatgtattccagaccttgttgaataccaacacagtagacagtttgctattataacttctagcaatagaatgaagagatgccaaaaataaggattacctaagggagactactgactagaattagaagaagatgggaggcttaacattgggaaaccacagtgtttaaaggacaaacagaataaggactaggagctggggcatgtcagtgagagggtaggaaggagccaggaggccagggcgggctacccatcccctccatgcaccactagtgattactatgtcactaatccaacataggcttcacagtcctagctttcagaatgctctccttgaaatttcttgtctgttccttttttctgaagaacatgcatcctgaatgttggatcatgaaaagtcttgaatgctgtactagctcttcctggctaggcagtggggaaccactgttttttagtaagtcacctgaactcattaatgctctgatatatcactcgcctgaactcattaatgctctgattaatgactcattagcattgtaagaaatgggttgcaggcgggacaagcacctgttgggagggaaaggaatgtgtaatgtaaaacagtagtagtggtggggcatgggcacatttaagcagcagaggggtaggtgggagctggtggcaaggagtgggaagggagaggcaagatgacttcagattttagtttacttgattagcagcatagcatcaacaaatgagttgggcgctatgaaaggaaaagcagatttggacattgctgagtttggggagccaatggaatatccaggtgggaatttccattaggcagttgtagataaaaggttcaaaagctgaggaaagggtctggaatctaaatctgtaagtaatcacttggaatttatacatccttggttttctttcctattatctctaaattatttcactattgttaatatacgtttatacctctgacactgtatgctgattagatcctgccttagagatagctcccttcccctctttctctttacagctcacacgttttgctctacctacaattgtttctacctgttggtatgtttagttctacctgattctactctatccgccttagatatacagctctctctttccagttggaaaatgttccctacctccaaagtctttcacttttaacttgtgtggaagataattatcgtgctatttagggaaaaataatcaagtatgttaagaatgccttatattcagatatatttatagtagaagggaccagtgcatactgaatattattactctcctaggcactacggctttggaaccactactttgccttctggtcctaaaaaaaattatttttgatgtatcagaaatatacatgataacattttccttatgtaaataaaagctattaaaccttttttatatagagcagtggacttccatactgctatcatttgaatataaagaagcaattttgttaatttacctagatttagattttagatttgctgttttgtcatttcgtgcccttaggcaggttatttaacctatttgatctctagttgcttggtatatgggaggcatgcataatattttgctgtgactagtaggttaaccacattgtgaaggaatttatggcatgatcagaatgtttttttctctctctagatgttgttattcatgaggaccaatggattggtgagacagtactacaatcaacatttagcagtcagttattaaatcttgggagttattcatctattcagcctgaagaatgtaaggcacattttaaatgaagtaatgtattagtgtttaaagtataaaaacatactaggaaagattagagttaaaatggttcttttacaaaatgttttctaaacagttggagagtattggtttcttttcattagtaagaatgaaaatagaattttaagaaatgaacttgtacattgtaaatcacatttattttaagaagtattgggtatcatgtttcgttttcttaggctgtcagtatagtggtggttcttcaccttttagggagtcagagacctctttgagaatctatagaccatttctccagaaaactggacttatgtagataggcacaaaattttgcttataattctaaagcattccgtggacctctgaagttcttctgtggaacttctgagcctctgattaagaatccttgaggtaataaaaatgtattggtctcgtattcagacagctgtggtttgaatccttattctcctgtctaccactgctaagaaaagctatctttcttctttaatgtccagttttctcttctttaaaagaagctgtttaatgaggaaactagcagctatctcctccactaggaaataaaatgacataaaaaaaagaaagaaaacaaagtaagggaaacagtataaacttgtggttttggtcactggactcagatagaccaggatttgaatcctggccctcttacttccagtctttgtctttaggcaagttatttcacttcactatacctttatctccttttctgtgaaatggagataaaaatacatatataccttatagggttgttatgaagattaagtgagaaaatgaatataagatgttgaacctgcacataatgtagtagtaacatagtaatattagagggagaaataataagctagcaaaatatatttgataaaatgctgaagtatcatacaagaaaatagctagagaaatatactgattatacaagaagataactggaataataggaaagttataggatgtatatggaagatagagcatggaattccaatctttgaattcttaaagaaaggcagagcaagtagaagggaagagcaacaattagaataacaagaactgtgtttgggatgggcaaggtttcattatatactagggtggcccatcagcagaaaaccaactctgacatatttcatagacaactcaaatagagttcttcatctatccaatatatatttattatgtgttgacattgtttcaggcactgtgtttactgtacactgggggtacaatggtgcctgtcctcctggagcttatgttctcatgtggaagacagaccaaaaaaaatgaatgaaacagacatataagtaaaatatttgcaggtgataatgagtgctatgaaggaaactaacaaagggttaagatacagaatgccatggttctagttgagaaggattgatcatggagtagaatcagggttaggaagttgttacaatagctgcagttgagagataatgggaggccagtggagctaaagagccgagatatatttgtaaatagagttaataggattttctgatgatgtgggtctggggatcagggaagagggacaatctactgctactggattactggtttaagtaactaggtagcctttattgtgaaagactgagagggaactggtttgtggggaaaagggctatgtttcaaggcatgttaagttttagatatctttgagatattcaagtggagatgtcatataagaactggaaacaaagttcaggactcagaagacaggtttaaaattaagaggcaaattttagagttattagcatacagataatatttcaaatttaaaagtttttaaaataaatattatctgtataattatagaatcacaggggattgcaaaaataatacataaagtcccatgaactcttcttctagcttctcccaatggtgatatcttatataactttagtacaatatcaacaacaggaaatcaacatttgtataatactgttaactagtaatatactaggatactttccctttcagtatcaataaatatagtatcagcctggcacagtggcttatgcctgtaatcccagcactctgggtggctgaggcaggaggattacttgggcccaggagctcgacaccagcctggatgatatggtgaaacctcatctctactaaaaatatggaaaaattagccaggtgtagtggtgcacacctgtagttacagctactggggaggcttaagtgggaaagaaagttgaggctgcagtgagccatgattgtaccacagcacttctgcctgggtgaccagagtcagaccttgtctcaaaaaaaatttttttcttaaataaataaatatagcatcaatacagcattataatatgattaatactatatcaataaaatagatacttagtcctaatgccaatgtcttatttaatagaaaagcactcgaggcattgtcattaaaaccaggaaaaagataaggatgtccactatctctgcaactattcatcttatactagaattatcagctaacgcacttagacaagaagaggcatctggtctggtgcggtggctcacgcctgtaatcccagcactttgagaggccaaggtgggcggatctcttgaggccaggagtttgggaccagcctggccaacatagcaaaaccctgtctgtactaaaaagatgaaaaattagccaggtgtggtggtgcatgcctgtggtcccagctactcaggaggctgaggcatgagaattgcctgaacctaggaggtggaggttgcagtgagcacctgtacactgcactgcagcctgagggacagagcgagattctgtctccaaaaaaaaaaaaaaaaaaaaaaagaaagaagaggcatttgaacatttgaatggataaagaagaatgaaaattatctctatttacaaatgctctgataacatacctgaaaactccagggaatcaaagttaaaacaaatttaaataataagataattcaatgatataacaggatgcaaaattaatgttaaaaaatatcattaggctgagtgcagtggtttgcgtctgtaattctagccctttgggagatgaaagtgggtggacagcttgagcccaggaattcaagaccagcctgggctacaaaaaagaaaaaggaaaagaaaaagaaaaagaaaaaaatgctgggtgtggtggcacacacctgtggtcccagctgtttgggaggctgaggtaaaaggattgcttgagcccaggctgggggatgaggttgcagtgagctgtgattgcaccactgtactccagcctgggcaacagagcaaggccctgtctcaaaaaaaaataataataatagtaattagacaatatacacaaataacaaacagagggcataatgatagtgaaaaactcatttactatagtaataaagaagatagttcaaaatacagttaacaagaaatatgcaaagcctatatgaggaaaaaatttaaacactccagaaagaaatgaagacatgaataaatggaaagacatttcctgttcttggataggatgactcaacattataatgatgtcagttcttcctaagttaatatgtaaattcaatgtagttccaatgaaaatatatgtgttgtggcatataaaagttgatactaaagctcatatgggaaaacagacatgcaagaatagctaggaaaagactgacaaaggaaaactacagaggaggggaactagctttaccagatgttaaaacatactataaagcctctgtaattaaaacagtgaagtactgatgcatgaatagacaagtagaccagtggaatagagtaagaagattagaattagacccacctacatatagcaatttaatatatgacaaagatagtatctggaatcagtgagataaaagctaacttcttaataaatggtgctgagacaactgggtagccatttggaaaaaagggaaaattggacacgtatctcacaacaaacagtaataaacaccatatggattaatagtctaaatgtaaaaaataaaatcatgcaacaacaagaaggaaacctgaatgaatcctctgtaatcttggtgtagggaaaggctttttcttaatattactcagaatccaggggcagtagaagataaactgatacattttactgtagaaaaataaattttgcataaccaaaacactataaacaaagtcaaaagacaactgacaaacttggagaaaatatttgtaacatacaacaaaaggctaatatccctaatatataaagaacttttaaaccttgagtgacaaagtctgggtgtggttgttcacactggtaatcatagcattttggaaagctgaggtgggagaatcacttgagctcaggagtttgagtccagcctgggcaacatagtgagaccctgtctctacaaaaagtcaaaaaattagccaggtgtggtggtgcatgcctatggtcccagctacataggaggctgaggcaggaggattgtttgagcccaggaggtcgaggctgcagtgagctgtattcatgccactgcactctagcctggcaaaagggaaaatgtgaaaaagagatgaacagtcaattttcaaaaaaagatataaaaatggctatcaaatataacttattagagaaattcaaattaaaactacatggagataccatttctcacctatcagattggcaaaattaaaaaaaaaaaaagcacattctgttggcgcaactgtgaggtaatgtgccctcttatacattggtggtaggaatgcaaattgctacaacccttttgaagggatatttggcaatatctaacaaaattacatatgtacttagctttcaacctagcaatcccacttctaggaatctaccctgaagctacatctccaacaatatgaaaatacatatcacaaggttattcattgcagtattgtttataattgcaaaatatataggagaatgattcactaagttatggtacattcacatagtggaacactatgtactatgcagctgtacaaaaagaatgaaaaagatctctacgaactgatatggagtgattcccaggacatactgttatgtgaaaacataaaccccccaaaactgtatgtagtatgctgtccttcctgtaagaaggattggaggaataagaaaatacctctgtttatttgtggaaagaaaatgcaggaaggataaaccagaaactaaagagattggtcacctacagggggcacgtaggagaggggtggaagaaagtggggaatgggaacaggatagcaggggtcaggaggaagtgacactaacaaatgaatgtattattgttacaaatgaacccaatattgttacaaatgaataaaataactacacagaagggggtggggaagaaaagaacaaacctaagtagctgtggaaaagagtatattgactggattctataaggctaatgacagaaaggactgtacataaatgctgcaatctagttagaaatatgtttctcaaaggggaatggcttagcaataaccttatgtacatactagaatgaacaaatgagtacatagattgtagataaggaaagctggatttctcactgttggagaaagaaattataaacaagggaaggttaaaacgaaccagaggtattgttataaactgaggatttttaatatagataaatggatacagaaatataggcatgtgtatatgggtgggatagtacacatacataaacatctcctagttctgtccattgagcgagcacagcacagatgcagttactccccagtaataatgagcatacctggtgcccagatcttcgtctgtaaacattttcttttcttttctttttttttttttttgagatggactcttgttctgtcacccagtctggagtgcagtggcgtgatcttggctcactgcaacctctgcctcctgggttctagcaattctcctgcttcagcctcccaagtagctgggactacaggtacgtgccaccacgcccagataatttttgtatttttagtagagatggggtttcaccatgttggccaggctggtcttgaactcctgacctcaaatgatctgcccactttggcctcccaaagtgctgagattgcacgtgtgagccaccgtgcccggcctctctttttttgagacagggtctggctctgttgcccaggctagagtacagtggtgcgatctcggcttactccaacttccgcctcctgggctcaagccagcctcccacttcagccttccaagtagccggcaccataggtgtgcactaccacgcctggctaatttttgtatttcttgtagagactggatttcaccatgttgctctggctggtctcggactcctgggcttcagcagtccacccatcttggcctcccaaaatgctgggattacaggtgtgagccattgtgcctggccaacatagttctctaatgaaaggaaccagctctgctaaaagtggttgattacaggactgggtcagggcaaattcaggataagcctggaagtctagtggtgccagacaagacatgttgaaataatgcaagagccaacctgaaggaacacctactggctaaagctgaagcaatttgagtaagaaaataatgatagtattggattagaacccatagattaaaatctttacaaatccttactgatataaagacatatttatttcattaactaaccagaggggaagagagagctcttccttccaatggaattccaattaataaatctgagagaaaagaaaaaaaaatagagaattactggccatgctcagtggttcatgcctataatcccagcactttgggaggctgaggcaggtgggtggcttgagcccaggagttcgagaccagcctgggcaacatggcaaaaccctgtctctacaaaaaatagaaaaattaaccaggtttggaggtgtgcccctatggtcccagctattcgggaggctgaggtgggaggattgattgatcccaggaggttgaggctgcagtgagccgtgatcatgccactgcacttcagcctgggcaacagagtgagactctgtctcaagaaaaaaaaaaaaatacaaaacacaaaaatagagaattaccatcaggcagagatcacaataataaatactgcaccgacacaaatgcactgatagatgctaaaattagtaggtgaaagtctgaggagagagagcattgcatagtctcaaagtatctccccaggataccagcttactagagggaaaataataaatttataagaaaactcttcagacaccaagttaactgagtgattggggtaaatatcaccagtaataagatgtatggtatcataaattctttgatattatccattgagaaggatccaccatattttttgtggaattgccaaaaatgcataacttcattccaatcataaaacactggagaaacccaaagggaaggacgttctactaaataaatgatcaggattcttcataagtgtcaaggtaatgaaaaagaaaagactgagaaactcttatagactagaggagaccaaagagaaataacaactaaatgtgaggtgggatcttggatgaaatcctacatagaaaaagcatattaataggagaattggtaaaatttaaataacatatacattttaattaacaatatttaattaacgttagtttcctgtttaagataatttataatatgtgagatgcccacattagtcgacatagtgaggaatataagggaactctgtactatttttgcaacttttttgtaagtcttacattagttcaaaacagagtttttaaaagagctgtatacgatcatctcaataggtacaaagaaagcttttgataaaattcaacacctgttcattaggaatagaataaaattttccttaacttcataaagagtgtctttagaaaacccagaacaattatcatcctaattggaaaaatattagaagcattccttttaaaattcaggaatatgactaggatactactattactacttttcttcaacaccatattagagttattaaccagtgcaataaacatggaaaaatagatatgtaaagattggaaaggtagaaataaaactgccattattatagatggtttacataccttttccctctgaaaactacaaacaaattatcagaaataatgtgaaaatttagcaaagtagctggatataagattaacatacaaaagtcaatcacatttctagagtagagcgactaacaataacaaaggaagctgtcattgacaacaatattattttgtactaatagtaataaatgtaacaaagtatgtgcaagacctaaaaaaggaaaaatttttaaatgaagaaaaactaacaaagaatgaaataaacatactttattcattaattggaagatttaacattgtgaagatttcagttcttttcaagttgatttgtaaattcagtgcatgttccataaaaatcctcgtaagatttcaagggcgcagtggctcatgcctgtaatgccagcactttgggaggccaaggtaggaggatctcttgaggcaaagagttaaagaccaataagattttcatgtaatttgataagattatatgatatttatgtagaagagtaagtggttgaaaacagcagggcattttaagaagaaaagcagggaagaataatttaccctatcagctatcaagacttagtatgaacctatagtaactgagatggtgtggttttgcccagttgaagtcagttaaattttaattttgagatttctgtaaaagatacaagtttagtcttttattatgtatatttgaaggtgttacattttggaaagtgtgtgtgtatgaatgatagctaaatggcttctaagtaaaattcagcatatcttgtagatgttgatagaatagaaggggaaggaatgttttgaaataatgaaaataacatggtatgcaaatgctttgcaagagatttgggaaatgtagatatctctggttttaaggatgatctagattcaagtaatagttcagtaatttcataaaactcttatgacaaaattctggatggagaatattctatgaatcccctagagagtttcaggtttttgtagaatgatgtgaaaaatcttgaactaattagataatctttagaagttacttcacaatctttgtttttacacatacacaggaatttatggtgctttattttttacaagttagtagctaaataaagtatattctaaagttttttattgatgtagggaaatggctaccagtggacattttgagaatattgcagttgttttccttctgaaagagtaaaccgggtcatgacgcagcgagtttcagtcgtgacttttctgggggcatcgcggcgtcccctttttttgcctttaaagtaaaacgtcgccccgacgcaccccccgcgtatttcggggggcggaggcggcgggccacggcgcgaagaggggcggtgctgacgccggccggtcacgtgggcgtgttgtggggggggaggggcgccgccgcgcggtcggttccgggcggttgggagcgcgcgagctagcgagcgagaggcagccgcgcccgccgccgcccctgctctgtatgccgctctctcccggcgcggccgccgccgatcacagcagcaggagccgccgccgccgcggttgatgtggttgggccggggctgaggaggccgccaagatgccgcagtcaaagtcccggaagatcgcgatcctgggctaccggtctgtggggaaatcctcattgacgattcaatttgttgaaggccaatttgtggactcctacgatccaaccatagaaaacacttttacaaagttgatcacagtaaatggacaagaatatcatctttaacttgtagacacagccgggcaagatgaatattctatctttcctcagacatactccatagatattaatggctatattcttgtgtattctgttacatcaatcaaaagttttgaagtgattaaagttatccatggcaaattgttggatatggtggggaaagtacaaatacctattatgttggttggaaataagaaagacctgcatatggaaagggtgatcagttatgaagaagggaaagctttggcagaatcttggaatgcagcttttttggaatcttctgctaaagaaaatcagactgctgttgatgtttttcgaaggatgattttggaggcagaaaaaatggacgggggcagcttcacaaggcaagtcttcatgctcggtgatgtgattctgctgcaaagcccgaggacactgggaatatattctagctgaagaagcaaactgcccgttctccttgaagataaactatgcttcttttttcttctgttaacctgaaagatatcatttgggtcagagctcccctcccttcagattatgttaactctgagtctgtccaaatgagttcacttccattttcaaattttaagcaatcatattttcaatttatatattgtgtttcttaatattatgaccaagaattttatcggcattaatttttcagtgtagtttgttgtttaaaataatgtaatcatcaaaatgatgcatattgttacactactattaactaggcttcaatatatcagtgtttatttcattgtgttaaatgtatacttgtaaataaaatagctgcaaacctcaaaaaaacaaaaaaaaacaaaaaaaagagtaaaccaatttggttactcattttaccaatttggttttgattttgcaagtggttacaactcatgagaggattcttatttctgatcaatatattgtgtttttggaaaggacttctgggaaataattatgatgaagccctcgagcaattgcaacaaaaccaaaaattgaaaagtgggacctaataatacttttttaaaatttattttttagagacaggatctcactctgttacccaggctggagtgcagtggcctgatcatagctcactgcagcctcaatctcccaggctcaagagattcttctacctcagcctcctgaatagctgggactacaggtgcatgcccccatgcccagctaatttttgtattttttgtagagaccaggttttgtcatgttgcccaagctggccttgaattcctgagctcaagcgatcctcttgtcttagcctcccaaagtgctggaattacatgtgtgagccaccactcccagccccagaacaactattattaaaaagtcaaaaaacgacagatgttggtaggctgtgtagaaaaggaaatgctcgtacactgttggtgggaatgtaaattagttcagccgctgttgaaaacagtttggggttttctcaaagaagttaaaactgaactatgatttgacccagcaatcccattactaggtatatatccaaaagaaaacaaattgttctaccaaaaagacataagcacttgaatattcattgtagcactattcacagtagcaaagtcatgcaatcaacctaggtggccatcagtggaggattgaataaagaaaatgtggtacatatacaccatggaattctacacagccataaaaaggaatgaaatcaggatggtgcggtggctcatgcctgtaattcccacactttgacaggctgaggcaggcagattgcttgagtccaggagtttgagaccagcctgggcaaggtggcaaaaccctgtctctacaaaaaatacaaaaaaattagctaggtgtggtggtgcacacctgtggccccagctatttgggaggctgaagtgggaggatcacctgagcccaggaggtggagtttacagtgagctgagattgtgccactgcattccagcctgggcaacagagtgacaccttgtctcaaaaaaataaataaataaataaataaattgcagcaacacagatgcagttggaagcaattatcctaagtgaattgagggaggaacaggaaaccaaataacgtgtattctcacttataagtgggagctaaacactggctactcatggacatagaggtgacaacaatacacactggggactactagagggagagggttgaaaaactacctgttgggtactgtgctcagtacctgggtgacaggatcacttgtaccccaaagttcagtatcacgcagtattcccaggtaacagacctgcacatgtacacccgaatctaaagtaaaagttgaaaagaaaagacttctgttctttcatctttatagtgaggtgttacatgttttacaaacctagttctgataatgtgacaggaatataaatttatcttgaatattattaaatatataagtcaaagatcaacacagtgtttccatgaggtagactttttttggaatctaaataaccatgtgtttccatgtaaatttttatgaatcagggacaaatatataatttgatgtcagagatgtttttgttccccaaaagctctatcttgttcatgaaaaacgaagcccagagaagttatgtacaagttcacagagctcattattgacaaaaccagaatttgaatacaactcttctgattccagatttgctggaaatactgtgaaagaagaattcagtctggtagtattacgtgtggttttaattttttctttgtaactttagtttgaattttatgtgtgtgtgagcatctgcatttacttttaaaaacttttattgtaaaagccttcaaacatatacaaaagtagagaatacaaagcataatgaacttaagtacctattagccagcttattaaaacatggtcagtcttgtttcacctgttacatcccttttcttttactgtctaaaggaaggaaagaagaatcacaaatcagtttatgaagtctgctttctaaaaagtacttaagtgtttattgccaatatcttattttggtcagcaatcaatcacgtactcaagcatacttctcttaccttcagagaaattaaaatttaatcagcaaaactcatcagcctgtacatttaaaatatatgcatgttattgtacagaaactataccttaataaaaagtgagaaaaaaaaatgagacaggaaagagaaaaacatttaaaagacatagtaactgaagaattaaataaccaatccaacacttgaaaaatattacaatgtagcacatgcttaaaagctctctgagctcagggaaaaaagcagcactgtgaatctatagtggtcatcattctatgtggtattgggtaggacaagaagacagccttgcagctggaaattggtgaggacggaggcctcgtgtggaaagagtaaggcacactcagggagagaaccagtgaggtggctctgagcctgtttcagaaggggcttgaggaagaacggcagaggctaggatagttgggaaagcaggatcaaatcagactccagggattggggaaccaattggctgttacagggtggtggagtcaaaaaagaacagaaattttgtgtttggttaattgatagaaaatgatattattaacaaagtaaagaagtatgggaacagcacaagttttttggggatagtaaataattccatttccattgattaaaaatatcaagtttatttttacatctaaactgattcaagacttagctattgtacatgttttagagaaaacaaaactatattttatatctaatcatactttacaacataaaatacagttctaaaaaatattatttgtcaagaaaaatgtaatgttgccatcttttgtctgtatgcatgttttttttccttagattccagtgtagttagtgacgttgtacttcaagacttactggcatatgtgtcctcaaaacattcctacctcagagatcttcctccgagacagcctcagagggtgaacagtatagactttgtagaattggagcaccttcaacctgatgtgttagtccacgcagtactaagagttgttgatttcctatactgacaggtaaacattttgactgcctccttaattttagattatgaaaaaattaagatacaagaccatcttagtgtaccatttggttatcactatatatgtatcatcagctattaaagtatggtatcacgtgtgatagagtaatgccaactaagatactcattttccttttccagaggcagtatacagttatagaggacagaagcagaaaaaagttatgttaacagtggaacaggcccaagatcaacattatgcgcttgtattatggggtcctggagcagcctggtaccctcaacttcaaaggaaaaaaggtaaatacaccaaaaagcatttaacctatttatatttcggtaaatgattaatgtttatgagcccaagatggagaaaatcttaagagacgagacagcatttgaaatacaagtgatcatgattgaatattcttctgcaaatttcttctgttaaaattttgtacctcttgtagcaattcatttatctaataagtcttcattaattaatggtggtgaaataaaggcttaaatttattcccagatatactactttacctttttagtgaagatcttacctccttcaaataatgttctttaaacatttaattctggagaagcttctacaatttttttttcagccagagtactctgataaataaatgctatgattataaggcagatgtcaagggagttaccttaactctttcaagtcacaattaatgttcaataaattacagtttcatatttttattatagttgttttaaaagcatgcactgttagccatccctagaatgttcagtgttaaaatatgacccatgattacatttttctttaaagcataaattatttctggtatattgaattaaatggaattgatgtttcattaaaatagtatagtgtcttccctttgctcttgtgagatcctttagttgtaacaatcaaagacagtttcatttgtggcttatgagttatttttccctgctaaattaatttagagattgattcagtatattattattttttacctgaaagagttaatgtctctccaaacttctgccttccaaatagttatttgtagataggatctatcacattgtctctcttaatcattaatagctatgactaggatttgagataagtctaactttggacttttatgttaagatcaaacagggacagatgtttggttgagcaagctgacaaacatgtatcagtgatagactaactatgatcattgaccaccatagcctggctgagaacatgagtctagtgcatgctacacaagaatgtaggtcacaggtatagtggagctgtaacagagcagattgctccatgtttaatgtgaatattcttttaaaattaatagttttttggttaatagaagagaaattacagttgtctctaggtgactctatggtgtttaggttagtattgaaaacgtatgaatccaggaattaagatgttgttgttctttgtacattcattcatccagccccccttatttgtaaccatcattttaaagttttaacatctacttcaatacctcacatcagtctttttaagataaaaataccaattttgaaggattacttaagtaattctattttcctgattttacttttcttttcaagagaccaaccccatttccaaattcccagcaaagagaatctgattgcccagagtaaatttgattcaaaaaactgtgatcaggaagacagggtcacgcaatacaaatatgagagcttgagcttatttcagtggatgggaaaacagttaagggaatcatttgtgatctgggtgaatacataaagatattcactaccaaaaatgtgtatgttcattagcttagaaagatatatgtaatgtattatttagtttaaaaagtagattataggccaggtgtggtggctcactcctgttaacccagtaccttgggaggctgaggtgggtggattgcttgagcccaggagtccaagttctcatcttaaaaaaaaataaaaaataaaaaaaattggattgtaaaacttcatgtatagaaaatatattatgttatcatataataaatatttttatgtttatataagttaatacacaaaaattttcaagaaaaccctttatatatgatagtatctcattttaataaaaatgtatctataagtacatatgtgcatttgaaaacctggaaatatgcatgtatagcaaaatgctagccgtagttatttctgtatagtagtattatatgtgctttaatttttttctttatacctttagtttgaatttcatatgtgtgtgagcatctgcatttacttttaaaaacttttattataaaagccttcaagcatatacaaaagtagagagaatactaagcataaggcactttttttttttgtttgtttgagacagagtttcattcttgtcacccaggctggaatgtagtggcatgatctctgctcactgcaacctccacctcctgggttcaagttattctcctgcctcagcctcccaagtaactggaattacaggcatgtgccatcatgcccagcttatttttgtatttttagtagagacgaggtttcaccatgttggccaggctggtctcgaactcctgatctcaggtgattcacccgcctcagcctcccaaagtgctgggattataggcatgagccagccaccgcacccggccagcataatgaacttcggtacctattagccagcttattaaaacatggtcagtcttgtttcacctgttacctccctcatctttactgtttaaatatttcacaataaatgtattttattttataattaaaaataaaattaaaaccttatgctttttaaaataaaagaatagttaatgtttggaaaatctagctaacaatgtgagaaaaaatagaattaaatttatactttatatttgtgccaatataaatttcagatacattagagattcaaatacaaaaataatgaaacaatgaatagtagaagaaaatataggcaaaattatttgtaatgcaaaggttggtagggtaaataaaatccaggaacaaaaactattatacataaaaaccaccatgtacaaaattgaaaggcaacaaaaaaaaaacagaaaaaaaattacattgtcagacaataatgcagtaagcaaaagacacatatctatagagttaaatggggaaaggatatgagtaggcaagtccccaaagaagaaataaaaatggccaataaatatatggaaaaattgttcttacaagtaattgaaaacacacaaagtaatgatgatagattatttttcttttaagaaattgattgagaagatatgggaaaacagctactgtcatcagctattggaaatgcaaactggcagaacctttcttgaggataactgacaattaatatgaacaaattgggggtacttttagcccaataattttagctctaggaacttatcataactatgtataaagatgtagctgaaaatgggtttatcatggtatcatgtataattgtgaaaaataaaaaacaaccagagtccctcaaaatagaggtttgctgtaataatttttaagattttggtgtatctggacaatggcatattatgtaatatttaaaagcaatgtagaataatacatacatataaaactatatttgacttattaagtcaatcccaataaataaaatcccaaacaactggttgtccgctaaaatgttaactgcttatttagggtgttgagattatggctgctatatgtttatttacttggcttctcttagcttacttttctaatcaggtattttgtaataagacaagaaagctattttagtgattggttttaagcagtaacttggaatatatgctttagttctagctagtgatgttctgtctttacagatttactgagatgtttgatgattttccaccaaaaaaaaaaaaaaatctttagtgaaagaaactaaggagatgagcaggtgtagtaaattagatttatggcctgaagtgagaaactaaaaagacagctgatgttatcagaaaaatgagtgctaagaaaccctcttttgttttattatagttttgaagttgaatttactaatacagaatatgataatacagataagttgaatttactaatagagaatataacagtaacaaggtctgtgttactgtggctttaagtattagaattgtggccggcgcggtggctcccgcctgtaatcccagcactttgggaagccgaggcgggcggatcacgaggtcaggagatggagaccatcctggctaacacagtgaaaccccgtctctactaaaaatgcaaaaaaaattagccgggcgtggtggcaggcgcctgtagtcccagctactccggaggctgaggcaggagaatggcttgaacccgggacgtggagcttgcagtgagccgagattgcgccactgtgctccagcctgggcaacagagcgagactccgtctcaaaaaaaaaaaaaaattgttactgagagttaaaaataagtactattgtgtctaaatgctttttgttctagaaaagttaactaagataactaaagtattgaaatatgagtgaaatattagacttgggttcatttcagtgtcctttctttaacaaaacaaaacaaaactttgcctatagatagatacatgagaattttctttacagaaagcagttggttattataaatgatgaccgttcaggagggcaaggaatctttagaaaatattttattaaaattatctctggtggcccggcgcggaggcttatgcctgtaatcccagcactgtgggaggccgaggtgggcggatcatgaggtcaggagttcaagaccagcctgaccaacatggcgaaaccctgtctctactaaaaatacaaaaattagccgggagtggtggcacgcacctgtaatcccagctactcaggaggccgaggcaggagaatcacttgaacctgggaggtggaggtttcagtgagccgagatcacaccactgctctccagcctgggcaacagagcgagactctgtcttggaaaaaaaaaataataataataatctctagcatgcttctgttgtcttaatgcaccattcatattttgtctctgtttacccaaattctttagtgataaaagattagtattcaactgacttaatcagatcaatctatttaatctgatactaagcctagattttttttcctttttggtgacttttgtttttactgtttttgtttaaggttatatttgggaatttaaatatctttttgttcagcgcaattacacactagaaaacctagaattgcatacaacgccttggtcatcctgtgagtgcttgtttgatgatgatataagggcaattacatttaaagcaaaatttcaaaaaagtgcaccctcctttgtgaagatatcagacttagcaacccacctagaggataagtgttcaggtaagatttttatatacataaattctgctatttttatttcttttgaaacagagtcttgctctgttgctcaggctggaatacagtggtgtgaacacagctcactgcagtctccacctctcaggtttaagtgattctccccgctcagcctttcgcgtagctgaggagggaagggaaggctagtgcataccatcagtgcatgccaccacacccagctatttatttatttattattttggcagagacagagtctccctatgttgcccagtctggtctcaaactcctggactcaagtgatcctcttgccttggactcccaaagtgctggaattacaggcatgagccaccacacccagcccactgctagttttaatataagcaaaaaggctaccacttgtggtaaaaatgtataagtctatataaaagtgaaatataaatctttgcaaatatctgaactagattccagtagttttaggaactatgtgctaggaaccagggacaaagagcaaatacctattttttattatatgacaagtgggagcagaaattcagatccttactttatcttggccaaatgccagattaaaatgttactagttgggttaattcacatatatgtgtaaatatgttttccaatatatgattgaagggttagcattgttatatcataaaactatgctaaggagaatacaggcagaaaacaaagacaatacctctcaaaaaacccaacttttaattgaatacagagatttcattctcagagaagaactccttattcttagttctacactgaaacatttactaataccagcagatagtttaaattaataatatttctggaaggtaaacacagatgatagaaaatttataagcttttatactataaaaatttcatactattttcaaaaatggaagttgcctatggtcataaaagactctagatttatactaactggtaaaatcttggtaatgttatagcatcatgtaagttcctaagccagttttatatttatgtgcccctcccgtgctctgcttctccaacttcacagacatatagaggtggtcaccacaggaaggaatgccagacacagttgaggggctaccttactttgcagagacgtttagtttggtgccatggagaagtcaactctgttatttactgcttacacaaaacagttatctgctgggattgaagtctagaattaggtttaaaaataaaaataaataacatcatggacaacaacaaaataggaggccaccacgctgatgatgaaagattctcaggctatagccccacttgtttgaggacgcagccaggaattgtgcatgttcttggaagtcctggaggtgtgctcctcattagcaagccatgccaaaactgtgccattaaaatcagtccttcagaggctttgttcacagaggcctgtttagcctttttcattctctttatgttcagctatgagggctgaattcatagtttctgtcatagtgtatgtgtttttaagacaaaaatggagagagaatatgaaaacacaagcaacttttccctaacctattttatagttaaataaaaggagaaagagagatcagcatgggagcatttcctagaagggtctgcttgctcaacaaaagccagagggggatgaggctaggcctgagtccttgtaaagaaatgaagacgcttacccagtacctcatcttaccgccagcagaatttcagtgctcagcggagtgacccccttgaaagcaaagtccacattcagcgtgaccttttaattcttttcaagagttgtgtaaatttacaaaatgataggattatgtgaacattcttttaaaattattgaattattacgaattttttaggctgggcagggtggctcatgcctataattccagcactttgggaggccgaggtgggtggatcatttgaggtcaggagtttgagaccagcctggccaacgtggtgaaaccctgcctctactaaaaatacaaaaattagccaggcatgatgtcgggtgcctgtagtcccagctacttgggaggctgaggcaggaaaattgcttgaacgcaggaggcagaggttgcagtgagccgagattgcaccactgcagtgcagactgggtgacagagcaatactctgtctcaaaaaaaaaaaaaaaaaaaaaaagactttttgagtggagggaggagagcaagggttgaaaaactaactgttgggtactctgcctactacaggagactacttgggtgatgatatgcccatgtaacaaacctgcacatctaccctctgaatctaaaataaaaatcgaaatttttttttttacatatttttttaggccagacacattggctcaagcctgtaatcccagcattctgggaggccaagaagagtggatcacttgagcccaggagttggagaccagcctggtcaacatggcaaatccccatctccacaaaaaaatacaaaaattagccaggtgtggtggtgtgtgcctgtagtcccagctactcaggaagctgaggtgggaggatcacttgtgcccagggaggttgagactgcagtgagtcaagattgcaccactgcactctagcctggacgacagagtgagactgtctcaaaacaacaaaaaataataattttgtagtgatttaacatgtctttggaaagatgtggtattgaatcttctacagtttgttacatattcgatcgctacgcactcctgctaactcatgtagggatatgtgacacaattggaagagatgatgaaaccgtctttgggcattgaaagactaaagcaaatgaagttaagaacagaagactcatcattaactggactctgaaagagataaccagaaaacagtaggagactagagtgattagttcttgacctggagtgttcttacttctaagtggatgaagaagaacaaatttgaaggcttaaggcttaaagaagcctttaaattgactatggagaaagggagaataatgctcaagaaaactcatagacctcaccagtacacagtaagacaaaagtaaattaggaaaaaataatgtctgggagatagtagactttcagtatttgtttactggtgaatggatgagccattagcagtgaattatgaatatgcttgaggtttcttgtgagtcacctgagaaacgattaataaatgagaactttttataacccacagccagagtatatagatgataatggtgagcggaaagttggaaaaaagtttaaaagagaacaggctattgatatttttacgtagagagaagaagaaaagttcacctcctatttggctttttttttttttttttttgagacggagtctcgctctttcgcccaggccggtgtgcagtggtgtgatcttggctcactataagctctgcctcctgggttcaagccattctcctgcctcagcctcccgagtagctgggactacaggcgccagccaccgcgcccggctaattttttgtatttttagtagagacagggtttcaccatgttagccaggatggtctcgatctcctgacctcgtgatctgcccgcgtcggcctcccaaagtgctgggattacaggtgtgagccactgtgcccggcccctatctggcttttcaccatgatcagtttaaaagaagacagggcaaggagagagggcatgttagctagtttcaagtattcgaagggatttcttctaaaggaggtattgaacttattttgcctgattccagaggatggggaaggaaggaaacatcacatgttcagccaaattagccaagtaaacctgctctcagttgcagccagacctccctgcccttagattctaggaaaatagtaaagaagacgaagaacaagacctcagtgtatccttttactacaagtgactgtaaatcaactataaaattagccatgtttgtaaattaaagttataattttggcccaataatttataacatatctgtttgttgtttgtaggagtggttctaattaaagcccagatttcagagctggcatttcctcttacagcagctcagaagatatctctaaatgctcacagttctctgaagagtattttttcttctcttcccaacatcatatatactggctgtgcaaaatgtggattggaactagaaacagatgagaacaggatctacaaacaatgttttagctgcttgccatttactatgaagaaaatatattataggtaaggcaactaagcaagccaatttgatggaaaataattattatagatctggaaaaactagtctgtaaactcttactttctaaaaagaattaactagagctagtcgaagagaataaaattttccctgagtgatagatagctatttatggtagcaaaaattacccaggaatcgttataggaatttcttaaagataggaatttcttaaagcagtaattgggagattttattgtcttcaaacagctgtaccaaagaaacattttccttggtttactttttaaccaaaatctaaatgctcataaataactcattttcccaccttaacatataattagaatttaaaggctaaaagtatcatatgatgtcacctctgagttgttgtggaagctagtaagacatttaagctgttttcccacctttaccttagaaattaaagccagcaaataaatgttgtatggtaaaactgctaatcagctcagtgaaaaacacattgttttttgaataataggtagtcaaaagctcagacatttttctctttaccttataaattacatgtgtttacaaaatagcactcagtgttttatgctccttatgattatttctaaatattgcggtatctaaaaactaaattcagatatattccacatgttatcatggcatacttcaagaaaagttatagaagcttaatttgtaaaccttatttctctttacagatattatgtttgttataaataagtgaatgaattttgctattactgtgaaagttgcttttgtggaaaagaagattgaattaagatgtatggtaggctgggtgtggtggctcatgcctgtaatcccagcactttgggaggccgtggtggggggatcgcttgagcccaggggttcaagaccagcctgggaaacatagggaaaccccatctctaccaaaaaaaaaaaaaaaagctgggcatggtgacataggcctgtagtcccagctacttgggaggctgaggcaggaggattgtttgagcccaggagatcaattgttacagtgagctatgtttgcaccactgcactctagcttgtgcaacagagtgagaccctgtctcaaaatcaaaacaaaaaatgcatggtatgtaacaaacaacattgatttattaatagttaaggcccctcaaaagtatgtataggtgacttatttatatcattccaaatgtttctattcaatataagcatttattggacaaaaatactgctcaatactattccttatggggaggagggcctttgaatctttagtttacaaaatgactgttcaagagaaggacttcacagatcagtatcacctgattatggcataactagtatgaggtatttaagatctcttcctaaactataccacattaaagatgtagtgctagtttgttgtcttactagaatgttgaatggtcatgttaaggcaagaattattattttttatttatttaaaagccttttttttttattttttgagacagagtttcgctcttgttgcccaggctggagtgcactggtgcgatctcagctcatcgcaacctctgcctcccaggttcaagtgattcttctgtctcagcctcccaagtagctgggattacaggcatgtgccaccacgcctggctaattttgtatttttatagagacagggtttctccatgttggtcaggctggtctcgaactcctgacctcaggtgatccacccgtctcagcctcccaaagtgctggaattacaggtgtgagccaccaagcccagcctaaaagcctttaaattattagagtccagattatgtggtttccttggaaagaaaatattgaaattaacaaactcccttcaagttatcaagtatgtgactccaaaatcatctatataaatcaatcagcaaactgaataagagaaaactctcattgattatttttctaagactcagtcaaatatttattaggaatccacgtatgttcacatatcacatgtgtactgtggatgttatactagttgatctaagtagacttattgtgcccaagaagcttggtagtccatttaagaaacacttaatgaacatttgtgtggcacaacagtcccaaactatgagtgggttgatcatattttacattggttgtaacttggagctgattttccaatggaagcaacattagatattgcaatggagtctcatacgaggccacagacatttattaaattaacatgtagatagcatagttcctgctcttcaagctatcataaaactcaaataccatttttaacaatgtttctacagaatattcagatttacatttttggaatacaagaaatacatttatttttctgtactggaagcaaaaaaccccagcaggtcaaaccacaattaaggctcctatttaggcagcactaggaaatgtttgggtctctcaagaggttgtaatcaaggtgtaggctggggctgcagtcatctgaaggcttgactggggctggaggattcatttccaaagtggctcattcatatggctgacaagttgagttcctcttcacttgggtgtctccacgggctgcctgaatgttctcacaaagtggcagctcatttcctcagagcaggaaaggcaagaaagagagttccaggtggaagccagcctttttgtgacctagactcagaagtcatgtggcatcacttctatcaaattctgttcatcagaagtgagtttagctgtgcgttggagagtggattagaatgaagctagtgcagagaagcggtaagaggctgttgccttattttggaggggagatgatggtggcttgactagagaggaagcggtaggaataaaaagaagtggacagatttgagaatggtcggaaaatagtttgcaagatgtagtgattggtaggtaaagagagagcacaggtacattgcaaatcattgacagttgggtgaacaataagattatttattaaaacaagtaaccttgggagaaatcttgatcatattgagcttgagttcctgagaggtaacaagttggaaagtggttagatgtaaagaaatgcaatttgcaagagaagtctgggctaggcttataaggttatctgtggtgattgaacttttccttggtttctgcaccctgttttgtttttccttcttaatcttcagtgattacctctcataatggattattcttactagcctataaagacagtcccatatttctcttattaaaaaacaaacaaaatcatccattaacattacatctccctcttatcccttcgtttttctattctgttttatacccagccaaactttgttaaagagttgtaaatatactctctctcccctattatgtcttcagtttcacttcagttattccattctactcctaccatgctgcagaagctgcttttgtcaaagttacacttttgatgttgcctgaggcatggatacttctttcctcgctctaactgctctcagttatattcagcatgtcagtccacttcctccttcttgaaacagcctcctccttgctttctaacctgtctctcaggcccttctttctcagccttttctaccccctctttaaatgctggggttaatcttgagctctcgtctgtgtccttcctcttattctttctgtacattctgcctggatgatcacagctgttttcgtatttgtacttaacatcttcaccctgattttctcctccaggctccagtagtcaggtatcaaattctttgcttgatgtccatctcacatttaaacatacccacaatagactcttgtttttcctaaaaccacactcaaatctagttctcttcgtttttatactttctggaaaatggcacaccatctacccaattatttaggctggaaacctgggcacaatcgttgcatcattttctcttccctacctcccctatctaatctattagcaagtcctaggaattttcattcagaactatatcacaaattcatccacttttttccatctccactgctaacatcttagtccagtgtatctcagcaggggcattgttgacatttttctcaggacagtttctcattatgtaccatatcccacatgctgcggggcatgtggcatccctgtttaccttcccctagctgaacctcaattactgtgaaaccaaaatggaaagtcagtgcctgctggtctggaatcactcaggcctcatctgagtccctactacctattgcgcaaaccagcacaccagcagtctcttggtggggctcctcctggccttgcctcctcccctttattctccacccgttggcagtgtgattaccctttgcttcacccatcagtcatctccttgtgcttgtttcctctgcagtctcatctgctgccactcccctgtcgtccagcactctagccacgtggccttctttcagttcttcagacattttgatttttctccttaggatgttctcgaatgtcttccctctgtctgactccacaaggctggtttcttcatgtcttagattaaatgctgctctatcagagaggcctttcctaaccacccttctttattttctgttatagtagcctgggtgtgcttactgtaatttgtatttgcatactgtcttttctaaaaaacatttttactgaagttaaaattcatataccatcaaattaatcttctgaaatgtacaattcaatggctgtagtatattccaagggctgtgtagctatcaccacaaccagttaggacattttcattacccagccctttacaaagcctcatactcattagcagtcactctccattccccatgcccctcaacccatggcaactacgaatctgctttctgtctctatagatttgtctgttctagatattttatataaatattatataatatgtgatcttttgtgactggcttcacttagcatgatgttttcaaggtccatccatgttgtagcatgtatcactacttcattcctttttattgcaaaataatattttattgtatgcacataccacattttatttatccattcatcagttgatggacaattgggttgtttctactctttggctattatgaatgatgctgctgtgaacatttgtgtacaagtttttgtgtggatatgtgtgttcatttctcttgggtatatatctaggagtggtggaattgctgggtcatatggtaactgtctgtttaaccttttgaggaactaccaggctgttttccaaaattgctgcacaattttacattctcatcagcaatatgagggttgtaatttccccatattcttgccagtacttcttattccgtttttctttttgttgcatgtgctttcgggtcatatctaagaaaggtgtcatttctaagccaaggttatggagatttgctcccgtattttcttctaagagtttagtagttttacctcctacatttaggtttattatctactttgagttaagttttgtatatgggataaggaaggggtataattttattttttggcatgtggatatctagttgtcccagcatgaatttttgaaaagactgttccatccctgtttagtcatcttggcaccactgttgaaaagcttattttctttcttcttctttttgtagagatgaggtctcgttgtgttgcccaggctggtctcaaactcctggcctcaagcagtcctcctcaccttggcatcccaaagcgctgggattacaggcatgagccaccgcgcatgcccaatttcttcctatccctctacagttttacgttccttgagtgacggaaccagatttgtctttttcactagtgggtacccagcacttaccacagtccatgatagatactcagtttgtatttgttgaaataaataatggagggagagagaggctgaggaaagagtgtagagtgaaaagaggaaggaacatagagtcatcgtgtgaataaagggggaagtgggtttttagggggaaaatcagtagttatgttttagctctgttacattaaattcccccgctaatgagcctgtttctgaattctgttctcaatttattttttaaaaatcaatgtagttataaaataggtaccacatgccatggttaaaatgcacactacataggaggttataaaacaaagagtgaaagtctccttcaccatccaaccctctcccaccagtgctgcttccatgctggtgagaaggttttttgtatgtccttccagtgatttattatgttcatcccagcacatgtgtatccctttctttagaagcatgtggacagaagaatattgttcatattgttgttccctagagtctatcctggtgctccttccctaatagcacttgcaaatgttcttcattctttttatcagctacatagcattaagatgtaggatgcactgaaaattgttaatccagttttattgatatgcaaaacagtttatttctgataggaaagaattcagttgaaaaaagtaacttgaaattgtgattgtgaaatatgtgattattatttttattttcatttctaaaaataatttataaaacagtttaatatatttttatattagtatctgaaatttaaaaatggatatagaataaataaaatgtagtaatttatcatttgaagctcttggggaaaaaaaaacctttttttccttctaggatgtcacagaacatcctagagttgttttaagcattaaaattaatcctgcataaaaaccaagtgctttttggaattatttttcatttaagcatttcttttatttgaaaatctttttgaaggtcgtgtgttgtttactcttctgtaggccagcgttaatgactgccgttgatggaagacataatgtttacatccatgtagaatcaaagctgatagagaagattcttctcaacatttctgcagactgcctcaacagagtgataggtaatatatcagtgtgccatcaagaagttgttttattcaggagtataaatggtatatcagaacagaaagagcactgtactttaaattaagagcttttctgtccatatgaaaacagaaggataatttagcttaagtgaaatataagcctatgtaagttagaaggttgacttgctttacacctgttagtacatgaacagcgggaggcacctaatttcttcttaacctacatttcctgttggtaagcaaaaactattttacttaactctagttttataagaatgaagtcaatgagtgtatgacataatatatatgaagatagtccagtgtcagtggaatggatttgcaagatcttcaaccatgatgtcttagttgtcagtggctaagaataaagcaaagataatatatttgtcaggtattcaaactccattcctgttctcattagcctcagatcctctaagctgatgagctaatctggttctgtgattgctttatctttcaatagtagattgttttttgtgtttttttttagttgggggtgtctagtaattttgagttgaatgctgaacgttgcatatattaagtagaacagtacaaactgaggtaaatagtagttgtacctggaaacaggcatgcctcttctggtcctttactggaggtgaggggtgagcaggatggtcagccttgtcataagttgagttggattcaggttttgttgtttctctggttaccttcaggtcaccactggtttcaaattatcttgtgcttatggtgggaagtggttccccagtattcctgctccaccatcagcatagccctccactctgcacctgggcctcagagaaagtttctttccatattcttgcacctccccaagttgcacaagcttttgttggttgttatttggtgcatcctaacctggtgggtgggagcagggttgttcctctttgattctggtccagccccagtcttatacggatgttgcacatggcgctttcttggtagccctgtcccttatgtggcatggcagctgagctctgtcttgtgcctttagtgggtcttgtgtggtcctggccctgccccagcagtaggggaccactaatggtcttgacccagggtggtttttcagtcctcccccaggatggaggtttttttttttcttttttctttcccccatctgtactggttcctcacctgtaccctggggcaacaggatttggtgtccctcctccagcaattgaaggcttttgttccttaaaggggaggccagatggtgctttgtgttttgtagttggaagctttctctgatgtcttgccctgcccccagtcttatgagcacctggtggaggtgagacgtactatgtggaagagcctatgaggatgcagatgttccttatgttgctgacactggcagttcattggctttttgcaattaatttattaataaaaattaatcacattcttctttcctgcctgtatggaggacctgtcttcttcccaaggcctgccccaagggaacctgtgctcctgttccatctccctggaggcacctgtctccttatgtttcagtctttttggctgttttacaaccttggttctcatgtgtattcaagaaaatgatgattttatatttattcagttttttccagtaactgttagggtaggagccactttttccagctttctacatcttaattagaagcctctctccgttttttcccccattttctttatttcatttttattcttttggctattttcattccttttcttaatgttacttatatattttcagtgttatctcttctttttttttttgagatggagttttgctcttgttgcctagactggagtgctgtggcgcgatctcagttcaccataacctctgcctcctggattcaagcaagtctcctgcctcagtttcccaagtagctgggattacaggcatgtgccaccatgcccggctaattttgtatttttagtagatatggggtttctctatgttagtcaggctggtcttgaactcccaacctcaggtgatctgcctgcctcggtctcccaaagtgctgggattacaggcgtgagctgccgtgtccggcctatctcttcttttttgcataatgtaaattagtctttatctcttagagaagcataattctcatatcacatatacttcagtgttttgtccattcttgagacaattaaagttgtacttcttggcattaattagattgtgatcataagtcaaaatgtcattggtcataaagtggtcatcagaccatgcagactattactaatattggttatgttttagtttattgcagtgaaaatacaaaatttaaaagttattgtagagaattatcataccccccaaaatatgtcattggtcctccaggactctgtagtccccatccaagaaagactgtgataattgtcaaggggttagtacagtctgagcatggtcgatggtgctctgtcattctggtattgaacaacctcccaaatgtcttgattacatgtcctaaaaaagtgaggggaagagtgtaggacaaatgcaaaataaaataacacatttagctatacttttagtattttttattattgagattcaatatttaagtgaccgattcaagattcttttatataaaaaatgaatatatgcataagtaactgtgataagaactgtggatggataagagcactcgtctgatgtactgcagcataaccagaactgctgttggtctgaacggtgtgttatctgggcctgtttcttgtgtcagggggatcacatgctgtcactctggagtgcctcaatagcttgtaactagaaagagaaggtatagaaagagtagtttacttacctgtttatttatttagaggcagagtcttgctctgttgcccaggctggagtgcagtggcacaatctcagctcattgcaacctctacctcctgggttcaagcaaatctcctgcctcagcttcccgagtagctgggattacaggcatgtgccaccactcccggctaatttttgtatttttagtagagacagggttttactgtgttggccaggcatgtctcgaactcctgacctcaagtaatccagccacctccgtctcccagagtgctgggattacaggtgtgagccaccgctactggccgggaggagaaatttaaaatgggtttgagacttgaggaaccaaaagaaacaatgaaaccattcaatgtgtgtgctcctgtcaagctagcagcgatcttgagagctctgtgttttcgtcttctgcagttccttcctcagagatcacctatgggatggttgtggcagacctgttccactccttgttggcagtcagcgcagaaccttgtgtattgaagattcagagcctttttgtgttagatgaaaacagctatccattacaacaagatttctccctcctggatttttatcctgacatggtaaagcatggagccaatgcccgtctctgaggccagaggaagaaattgcaggcatttcaaggaagaagtactgaaatgatttgtcttttgaaataaatgaatgacagggcttttgctttggattttttatgaaatatattttacaaagagaattgcactagatatataaattaaaacttttttctaagaaaatcctgtgaggtttaaaaagattgtttttgtcttttggtttcttcctttcttctggagaaatgatctaccagtcaaggcaatatgtagcagatccctgggaattaaaggtttgcccatttgttcactgtatttagtccctgctacattccaggcatcgtactaagtatggggaaccacagagaagacactccttcagaaactgctgcagtgctttcgcttatccctacctaaaaaaccgtcaatgtgaaatcatttccttgattataactataatgataatggattagtttatataaacctatgtttagacaagttcaagacaagcgtgtctttctataaaaagtattgaaagtgaaggaaatgagatcatgtttcaatttattaaagcagggaagagcgttctgtggttagttcgtgtctaggatttgagtgccttactgaatgtatttaccagcaaacatgtagcaatctgttctctcattgtgattgtggaagaagctcatgtaaaatgatagtcattaatgaggaagtatggcgtggtacttattctgtaagttcagagtatgctgagtgttaatagattgtcatattgcctgaaaataaattcatgatgacatgaacaagcttcttttaccctgtgtatgtttttaaaaattcctttggttcagaggtggttgttgttttttaacttggcttccctaagaacgaaccacaagagttttgtgattctttcaaaaataatatgccaaaatgcctttgtgggagcacacacacacaaatgcatgtttctgtggagaaggatccatagctttcaacaaatcctcagagggttctgtgaccaagaaaggtaagaacaaggctttaactgatgagtttctttgtggggtagataagggaattagagcaaatgattgccaaagttttgtctagcaactaataaggtgggtacagaaagaattgactccattttgtatctagagagactggaattcaaacaaaatcattggctcccttcaatgattcgttgaatgggtgatgaaacttgagcctgtagttgacgccttctaatctgtgctctctcaactataaccacactaggcagagatttggaattctgatataaaatctgcccagtcaatataggccaaccaagagagctgttcgcttaagtgtgcccttccccacttcgtcctcaagtggagacctaatccctacatcaaccagaacataatccccaggaagagatggctcttcacatcctattgggaagaaatctttaaaccatttcaggtgagtcaacagatcacaccaacatctcttcacagttgttggtatgtatttcattaattaacacatatttccaggagcccttatttaggttgggaactgtttcctccagtcctgaggaatctgagctatctacagaagttatgagctatttaagtgggatcaggatcagcccattgctcctgctatggtctgaatgtgtcctcccaaaattcttacgttgaaacctcatctctgatggcattcagaagtggggcatctgggaggtgattagatcatgagggctctgcccttgtgaatgggatcagtgcccttacgaaagtggcccgagggagcttctttgtccccttctgccacaggatacagccagaaggtgtcatctttgaagcagagagcaagccctcactagattctcaattttctggcaccttgatcatcccagccttcaaactgtaaaaaataagtttctgttacttataaattgcccagtctgttattttgttatagcacccagaatggactaagacaccttctgtgtgtattctttacctgagttgacaagtaagtgtctttattctgttatgttttcataaaactcagtggggtagccagagtgtcatccagcagtcccatatctggcagtcttatggtgggcatttcagggagacctcattcttcatcttctgttagttcagcttgcagggacagctctcctatttttagagaatcatttttatttgttagtcacttagtttccccagaggtatcctttttctaacagcgttagaggcattcacctttctccccactagtaagatctgtgctgtttcattttacatcttttttttttttttggttgggggaaagggggctgatcatcaaatgagttgacaacattgggtgcatgatccaccctgcagacgttcgctgaatgtctaccatgtgctaggcactggaaatgcaaagacacaaatgtctgccttctgtaagttcacaggcaagctggtgaagaaatatttaaacaaaattatatcagcgccaggattaaatctgtgtggaatacagagccaaggcaaaagaggtaacagtaggatgggtttgttagtcatgactcttggttgcaagtgataaaaacccaactcagagtagcttgagcaaaaaagggggacttgattgactcacataaatgagggtagtaccagcttaaggcacagttgaatccattggcctaaattacctggttaccccaactccctaatctttctttctttctttctttctttctttctttctttctttctttctttctttctttctttctttctttctttctttctctttctttctctctttctttctttctttctttctttctttctttctttctttctttctttctttctttctttcttttttttctttctctctccctctccctctctctctctctctcatcagaagaggtcttttacgctgttattgcaaaagcatagatgtttctacagagttttgataggataacattttcacagtgattatgaatttacatcgtccctagaattctaaactactgggatctgaggccgtaagttgtttaagagtattctgacattaccttagattcagcaaaacttgaatagttgatcatgcctttcttagaagaaaatatctgtaatttctcagaacaatatagaatgagacagaaaaactaaccatccctatgtgccttattttaagtgatatatttgtatcctgatgggtttctaggtgttggaacacaggtcatgaatcatagaacaattagaataaagtgttcgtctttatcagtagcttaattctggcccttgatttaatgtcaacaggggagaaatgtgtgagaggggatgaggtttgccaattaattgtcattatgtctttggaggtcttgaacctgatttgttattaagaagtgaattctacccacttaaggcatacatttgctaaaggtgacctctctgcttccacgttgttaagaaatcgtgatttttttcaaaaccatcatcagctttacagtttttgaggaaagatctagaagcctgttaaaatggacttaccaggcagggttcagcccaggaaacacaagccactctgggtattctaaacagagagagattaatgtggaattcaggtgtttgcaaaggtattggaaggctggaggagcaggcatcagtctgagctccaggaggctgccacgtgaacggtggattcatgaaaacatcatcattggctgcaatcttagactgaggatgcagctgctggcatcccagcaactgactctcaagcacatggaagctgggagttatttgctgctgcccaaaactcagtccccacagctacacttgccaggaacagtagcttcaggaagatagcctggatttcactcatcttccatattgcacatgtgtgtgtgtttcattgatggaacatgattcacgctgagagctttagctgcaagaaagtttgggaaatatgtcttctctgaggcttttggtctttgcagttcaggagcagttaggaggtgggactggttggttgcagagtgagctgatttactgcacttagtctagcttattaaaggatcagcttataaacaccccaggtaatatcacaatacataagtgctacctaattactgtgtgggtctgttaccaagaatgtctaagtcaagaaattgaagattgtttccttcagattctgcatcctaatgtagaatctttcctattagagtataagtaaattattttggtgtgttatttaagaatatttgtgaataggcttaattaaacaccatgttaagaaattataaacttaaggccaggcacagtggctcacgcctataatcccagcactctgggaggctgaggcgggcagatcacttgaggtcaggagtttgagaccagcctggccaacatggtgaaacctcatctctactaaaaatacaaaagttagccaggcgtggtggtgcacacctgtaatcccagctacttgggaggctgaggcaggagaattgcttgaacctgggaggtggagcttgcagtgagctgagatcacgccagttcaactctagcctgggtgacagagtgagactctgtttaaaaaaaaaaaaaaaattataaacttaaaaaaaaaacgttttcctttaaacaaaaacgcatgttccttgttttttgttttgttttgttttgccttttttgagagacggtcttgctctgtcacccaggctggagtacagtggcacaattatggctcactgtagcctctacctcctgggcgcaagcaatccttccacctcagcctccctggtagctgggactataagggcagaccacaacaactgattttttattttttgtagagacagggtctccctacattgcccaggctggtcttgagctcctgggctcaaccgaccctcttgccttggcctcccaaagtgctaggactataggcgtgagccactgcaccaggccgtttctttttttttttaactttggaaaatatggatgaatgaaagtgagaaaagtaacccttctgttattctaccaaccaaagctaattgctgccaacattttaatagatattccttcagttgttttatgcatgtatgattttgtacatgtgtctgctttaaaatatatagtctttcaatgttgcccaggctggactcaaactcctgggctcaagtgatccatcacctcagcctcctgcatgtatctacatcttattttattttatttttagagacattctgttaaccaggttggagtgcagtggtgtgatcatggctcactgcagcctcagcctccctgggctcaagtgatcctcctgcctcagcctcctatgagtagctgggactacaggcatatgcctccatacctggacactttttgtattttttgtagagacatgtttttgccatgttgcccaggctggtctaaactcctggcctcaagtgatcccctttgcctcagcctcccaaagtgctgggattacaggtgtagactaccacgtctggccaacattctcattgatagtctttgcacacatctttcattccttctgggaatttattctaagaaaatagaattttggggtcaaagtacttgtatgtatgtatctgtaccaggaaaaaagcagaaattccagtatcaacagataacgagagccacgcagggtggtacatgcctgtagtcccagctactcaggaggctgaggcaggaggattgtgtggcatgagcccaggagttagaggctacagtgagctatgattgcaccactgtactccagcctgggcaatagagcaagaccctgtctctgaaaaaacaaaacaaaacagataaccattgttactattttgttgaacattttccagataccctgatagaagacagatctgtgcatgcacatacacaattttacataaatgggaccattccatataggccagtatctagtgtgtactttttttactccacaatttgccatatacgtctttccaaatcaatcaacatagattaaatcatatcaactacacaggattccatcatttgtgtgtgctcttgaatcctacttttaaaatgttctcagaaaggttatcctgaaatatattcctatcagaagttttccacactctctctaaactgaatggcataagtgaaagactagttgttaggtttaaaaaaggttatctgttttaattggaattttttttgaggttttctttttcttttttctttttctttttttttgagacacagtttcactctgtcaccctggctggagtgcagtggtgcgatcttggctcactgcaacatctgcctcctgggttcaagcgattctcctgcctcagcctcctgagtagctgggattacaggtgtgcaccaccatgcccagctagtttttgtatttttagtagagacaggattttgccatgttggccaggctagtcttgaacttctggcctcaagtgatctgcctgcctcagcctcccaaagtactgagactacaggtgtgaaccactgcgcccagccttaattgaattattttattgctaaagtgattgtacatttgcttcatatgcttatcagtcatttgcagtttgctttttcatattttaccttagaccatttttatgtgggagaagccttttattaaattagtatgttctccttataaagttagtaatttttaacatgtgttgcagacatttttcccaagcttgttatatatgtttgacatgcagaaatcataaatatttacgtggatcaacccatcaatctttttctttattgtttctagattttatggcatgcctagatagcttcttttctactataagattatacacattttcttcaaaaaattttctgaaacatttatgattgttatatttgtatttaaatctttaattatctaaaatttagtgcatggtatgaatggatctaactgattcattttcctaaaatggtcagctggttgtcccaacactattgatttctttctttcccatcagtgacatagatgtgatctttattataatatgaaattattattcctgctagcattacctgtggactttctagtctgtttcattgttctatatttattgctgagccagaaccatacagttagaattattataactttacatctgataggaaaagtacccccatatttttcttcattaaaattgtttttctcagacatctttgcccatctgttcttttttattccccattaagagtatatgttgcagtgttttttagtatattcagagtgtgtgaccatcagcacactcaattttggaacatttcatcacccccaaaagaatcatccatagttacattaactataccaccccacagctcttccttaagaggagctaacagtcgctcctccatacccaccccctttcccccaaccctaggtaaccactcttctacttagtggctgtatagatttcactattctgacatttcacatgaatggaatcatacaatatgtggtcctttgtaactgatttctttcacttggtatagtgttttcaaggttcacacatgtagcatgtatcactacttcattgtttttattgccaaataatattccattgtatggatataccgcattttatgtatctattcatcagttgatggccaactgagtttttcccactttttggttatttttaattgtactatcatgaacatttgtgtgcaagtctttgtgtggatgtatattttcatttctcttgggtatgtacccaggagtggaattgctgggttgtatggtttaaccatttgaggaactgccaaacttttctaatgcaggtgcactattttacattcccatgagaatgcattggagttctgatttctccacatcctcaccagcactttttattattatctgactttttgattatagccatcctagtgggcatgccatctgttcttgagataagtttagaatcatttttatcccattgatatttttaatgagattgctttgaatttatggatcatttggacatgttttcagtggttaaggcttactatttaagaagagcatgctttttcaattaataaagtattctttaatgttccttagctttagctttatttagcagtccacatttaaagggtattaactatggaaatttttttttttttttgatacagggtctcactctgttgcccaggctggagtgcagtggtatgatctcagctcactgcaacctctgcctctcaggctcaagctatcctcccacctcagcctccttggtaactggggctacaggcatgtgccaccacacctggataatttttgtattttttgtagagatggagttttgccatgttgcccaggctggtctggaactcctgggctcaagcaatccacctgcctcagcctcctaaagagcttggattacaggtatgagccatcagccagtttttttgtttttttaaatcattgatttcaactatgctctgttgaatcccttttccatcccctcatgtctcacatgcctcacataacttcccaggcattgtgttttagaaagtctggtattgtttaaattccaacctcattttgctcttctccagagcatgtccagctagtcactaaagggacttggaatggggaggagataggtgcacccttcctttcctttgactccagctgttggagctggagggagggcgtgaactggcaccgaggtgaattcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaattctgctatggtaaaaacagcaccatatattgaatgctgattcagagcatatacagccttctggagaatttgtcccaattctgcaagacattgccacctagctggtgctgcagcagagtttttaacaggctattccaccattctatcaatccaattgcttcagagtcatgcggaacatggtaagaccattggatcataagcgtgggcccattgctgacatctattgctaggaagtgacttatttgatcacacgcaatggtgtgtgatacactgtgatagtgtataaggcattcgtaagtctcttatggtagtttgggaagaggcactgcatgcagggaaggcaatccgtattcaaagtaagtgtctattcctataagaacaaaatgctgctacttccatgatgaaattcataccatgtaatcagcctgcccccaggcagccagccgattactccagggaatgtcaccatatcaggggctcaatattgtcctctgctactggtagactgagcaatcaagtcaggcttggtgagtggaagttcatattgttcaatatattttaacacagttaggcacaccagctgctgcagctgggacaggcagctccaggtgccagcatgagtgctagctcactataaggctttggctggaccagacacaccacaagcagcttccatggctgttacaagggaacacagttgtacctggaagcttgcagactccaggaaccacagggtcccatagcgggagtcacagctctggcctggggagctcccaggtctgggttcccatagagccacagctctttttttcttctctcttcttgtcatccacaacatggtgagcaaggggcatgtttcaaccttgtttgtgttacagcatttttagtcctgtcatttggcaagtcccaagttcttgtgctacctccaggaagaatgaggtatatagacaagtggagagtgagcaaagaggagctatattgagtgacagaataactcagaggatgtcctggagtgggcacctccattctgcagctgggcatcccaatatctgcatctctcagaagagatgaggccctggagtgggtagctgctctctgtagctggttgtcccaatgtctgctcagttctggctgagcctggggcttttataggtctcagaaaggaagaaatgcacactgatcagtccatgagaggccatggatggccccagaaaaggcatcacaagtttacactctggttcacgggactggcagcccagaccccagccttcacacccatcctggcctgaaggaaaggcctcaccaaggacccacccccttctgtgcaggagcctgtctgcctcctgctgccattcatggcacccaggctatttgtgccaaaggatgcctgcaggccagtgccaagctgccctcagcatctcctcagcttccctcccatgcttgtcagtgcccaaagcctgggcaggggccagagacagtatggtactggtgtatcagcactgcctcaagcatgtgcacacccaccaggctgcaacagcacctgagcctacccacaaccttgctccaagatcagagcagatgtcaagagtggggaggagccaggcaatgggagcagaagatacctccaagtctgcaagggcctggggttttttcctgtgcccccaagagtgtagagatgcctgactctgcagccgtggcttgggcatctgtagttgcatcttgaaggacaggtgtcctgtgtgctccatggaatgggaggcccagatctgcagccactacttgggctgctgcaactgttcccaggaagctctaactccaccaactcagaaggggcatgtttcccacttgtatccagctctttaccatgtttcaccgctgtagctgatgtgacggcagtggctgctccagatggggtgccactgccatctttgtagcagtagataattatactacagtgtatttttaccaggtaaagtaaggtttttatggttcactgaggacaatcaatgccttcataaactagaacctgaagactgatcttctgagaacatcaaagaaagactgtcattggcatgcacactacagtaaaacttcaggaccttgaaccttgggttcataatctcacaactgagaaggctccctttacactcttggaactgtacacccattagaagccttaaagaaaagctaaccaggggggtttctccccagaagatggcatccttgactgtgaacaggttttcccaagatcatggatcaagaattctctactatcatgagactcttatctttgattatttgtcccttgcttatgcttctatgaataatagaagtgaaagggttctcttgtgtgcatttatggggtatacttttatttgtgaaggattttgcagccagccttatacatggataaccttataccttaatagacaaaaatgaaggcccaatgtagatgagaaactttaatggtacgtacattgcctcataatcagtcagaaacagaacattgatttactcctcttaacccacatcatgggttaaggagaacatcgctgggaggctttcactcttctaaaagggcatcatttgttaggtcctttttccatagtttggaataaaagcggcaaagattaaaaatgtattcctcatgataggctctgaagcagattctactgtaaaggctatggttacacaataaactttaaattctcttgtgaaagttatgctaaataatagaattgatctggataagttactagctaaacagaagtatctgtacagctgctggcacttatggcctatggggaaaacatcacatattatagatttagttgtaggggattaatgaagagactcttttttttttttttttttttttgagacggagtctcgctctgtcgcccaggctggagtgcagtggcgggatctagcctcactgcaagctccgcctcccgggttcacgccattctcctgcctcagcctcccaagtagctgggactacaggcgcccgccactacgcccggctaattttttgtatttttagtagagacggggtttcaccgttttagccgggatggtctcgatctcctgacctcgtgatccgcccgcctcggcctcccaaagtgctgggattacaggcgtgagccaccgcgcccggccgagactctttagttaagtgagtagactcttcatgtagctcatcctttgatctatttaattttgggtggtttggtttatggggaccccgggtaaggagcacactccaaactcttggtattatcctactgatagtcataataatagtctttctggtgtgctatattctctttaaaagtgttaaatgtttgcatgcagacatctctagcatgtcaaatggtctctctttaactggaatgacaagagctgaaagaaatgtgcagccatgaggacaccgtaacttatgaatgacatgctgagaccagaaatccacaatgatggtaactgagagtggtgctaaggccctaagtttggtcacactctcacctaagtgagaacatgacctaaaaaaaaggggattcttttaaatgaaattatgggaggccattgttttggactgagctcatgcactaggccccaacagaccaaaccagacaaaactggggttgcttgtgctgaatgtaacataatcaaactacgtttgatcatggaaaacatagcaaacagattctagaacagaccaggttttgtttttcttctgtaaacagaatgttccaacatatggacataccctctactcggtccttgttcccatctttgccaaactcactgttctgctctttcccagtaagtttcaagagccatggtaatagtaacatcaataactaaagttttggtcaatatctcaagattgagaaaatgacccaaagagggaaattgttaaatcaagtttagcctaaagctgcctccttacatattaaagttcaacctaaaggtttttctatacatcgtgaactataacaagtgaagttgtaaaccaactgtagcccacatctgtaccaatcactgagttttggccaaatgtagctaacagttccaaccatgttcaaataaggcaaagacccagctgcaaccaatccagttgcttctgtacctcactttccttttgctgtccataaatcttcttccaccacgtggctgcgctacagtctctctaaatgtgctgtaattctgggtgctgcctgattctcccatcattcattgctcatactactttacatttaatttggttgaaatttttctcttaacgacaatcatagaatcagtgtaacaatctgtcttgaaaagtagtaaagtgtgttacttctataggagaaaacaagacatctgtaatgataagccagaatggtcactgcaaacagcaagatgtatatttaactcagcctattctttgtgtaaaatatatatatatataaaatttaaagtagtttgagcaatgaacgatgggagaatcaggcagctcccagaattacagcagatttagagagactgtagcgcagccacgtggtggaagaagatttatggacagcaaaaggaaagtgaggtacagaaacaactggattggttgcagctgggcctttgccttatttgaacattgttggaactgttagctacatttatatatatataatctatttatatattattaaatatatttacatttttatatattatatattattaaatatatttatttttatatatattatatattaaatatatttatatttagatatattatatattaaatatatttatatttagatatattatatattaaatatatttatatttagatatattatatattaaatatatttatatttagatatattatatattaaatatatttatatttatatatattatatattattaaatatatttatatttagatatattatatattattaaatatatttatatttagatatattatacattatatatttacatatatatttatatctttttatatataattttaaatttataaatatttatatataatatatataatatatttataactttaaatttataaatatttatttatatataatatataatatatttataaatgttaaatttataaatattaaatttatttatatttatttatatataatatatatttatttatatattatgtatatttatatatatggaaaacacattttaactagcttcttcactctctcttttatcacttttttacttagatttagaacaatgtgaatagttcatgagctcaaatgttctcccaagttcagttaataacaccagcttgaggttgctgtacacacttaaggaaatgtgctaatatttaataaaactaatattaataattacctcatagaccctccactctttctctttttcataataagcaaatctcctctttttataaggctcacattggagggtttatgccatatttattttaatacaccgactttgtgaagatatcctgagttctagaattttttacatcaacatttttcagattgatttgtcatgaatgttattccctgtccatctttttttcatctgtaactgtttattaggacttgttatgtaccagacattttgctagcaactttataagcagtatcccatgtaatcctcaaaatactctatgaggaatttttgttatttattctcctttacaggcaagggaatctaaatctcagggaagttcattacctgttccagtgttacagaggagaaaggtgatggaactgggatgttagttgcatccaggcaatcctacatcagctctcacttttaatctcttcccaactttgtctctctctatttcttttcagctgttaatgatttcatatgtatgattgattttgcctgactgagccaaactatattagcatgttattagattagaataacttaatctctttacttggagaaaaaaaaaacaaatcaattaaacaactgcactgatgagacagaggaactgttttaggcataatgtagtctagaagttttttgagtgtgatcaacagaccaacagcatccacatcatacacaaatgtattagaaatgcaaattcctgggtaccattccagcatgaatgaatcagaaactaaggaaacagcaatctgtcttttaacacatcttttaagtgaattttaaattctaaaatatattaaccactgccataacaaaggggtcagcaaattaatgaacatgagtcaagcttaggcacctcctatttgtttgctttttaaaatttcaatatgatatacatacatcatttaaaaatttttaagtgtataattctatggtagtaattacatgcaaaatgtataaacatcagaactatctatttctaaaattagctcatcactccaaacaaaaactatactcataaaacagtaacaccttttaactctcccctcacatcctagtaatcactaacatattttctatctctatgacttttcccattctagatatttcatatgtttgggatcatacaatatttgtccttttgagtctggcttatttcacttagaaaatgtttttaaggttcattatgctgtagtgtgtatcaaaacatcattcttttttatggctgaataataatcctttgtatttatgtacaacatttttgttcatctattcattgcttaaagattcatctgttagggtttttctaccttttgactattgtaaaaaatgctgcaaaaaaaaacactggtgtacaagtatctgtttgagtcacgcttgaattattttgggtatatacctagaagtggaattattctatgtttagctttttgattaacctccaaattgatttccacagtaagcgcacaatttgatattcccaccaccaatgtaagtgtctttaactttatccacatcttggctaaccctttttcctccccctattctctctctctatttatgtatttatttatttttattactgtcatcataatagttgtgaagaaggccaggtgtgctggctcatacctgtaataccagtactttggaaggctgaggcaggctgatcacctgaggtcagaagttcgagaccagcctggccaacacaatgaaaccctgtctctactaaaaatctgaaaaacaacaacaacaacaacaacaacaacaacaacaacaaaattagccgggcgttgtggcataagactgtagtcccagctgctcggggggctgaggcaggacaattgcttgttgaaacaggtgtcctttcctcactttgtttttgtttactttgttgaagatcggttggctgtaagtatttggatttatttctgggttctctattctgttccattggtttatgctcctatttttataccagagcttttgcactgcaaaaggaacagtcagcagagtaaatagacaacccgaagaacgggaaaaaatattcacactctgtacatctgagaaaggactaatatccagaatctacaatgaactcaaacaaatcaacaagaaaaaacaaacaatcccatcaaaaagtggactaaggacatgaatagacaattctcaaaagaagatacacaaatggctgacaaacatatgaaaaaatgctcaacatcactaatgatcaaggatgggtacaccagaatctcataaatcaccactaaagaacttactcatgtaaccaaacaccacctgttccccaaaaaactatggaaattaaaaaaataggttctttgtcttctgttattgagttttaaagattctttatatattttggatattaaatctttatgagatatatgatttgcaaatattttttccattctgtaagctatctctcactttcttcataataatgtcctttgatgaaccgatgttttcaactttgataaagttcaacttatctagttttttgttgctgtggtatttttggtgtcatatttaaaaatccattgccaaaccccagttcatatttatccctaagagtatcatggttttggctctcatatttgagtcatcgattcattttgaataaatttttgtatatagtatgagtaaattttttacacatggtgtgagttaatttttgtatatgggatgaagcctaaccttaatttgcctttggaaattcagttgtcctaacatcatttgttgaagatttttctttgcccattgaatagacttggcaggcttgttgaaaataaatatttcatatttatattatggaaatataaatatttccataaatatatggtttatgtctggattcaattctattccatgtatctatatacctatcctatgccaattccatgctgttttaattactgtaggtttttgataagttttgaaatggtagagtttgagtcctccaactttgtctttgttttttaggatttccatgtacaattctaggaatttgagaattggtatttcagtaccaattcagtactgtttcagtaaaatgactgttggaattttactaaatattgtattgaatctttagacagctttggtagttctgctattttagcactattaatttgtcttcaaatccatcaacacagggttgctttcaatttgtttagaacttctttaatttctttcagtgatgctttgctcttttcagtgtacaagtgttcacatttttcattaaatttattcttaggtgttttgttcttttagatactatcataaatggaatttgtttcctaattttgtttttggattatttatttctagcatatagagacatgaatgaatcttgtgtgttgaccttgtaatatgcacttttgctgaattttttattagctctagtagctttctgatggattttcttcagattttttttatatatagaattatgtaatctgaaaggagaaataatttattcctttccagtttggatacctcttatttgtctttcttgctgattgctctgctagaagttgcaatgttcactagtgattaaagcagacatccttgtcttgttcctgattttaaagaaaagtgttcagtctttcaccactgaataggttgttagctgggggtatttttaaaatgtcctttattaggttaaggaaattcccttctatatgctcagtgacttttatcatgaaggtgtgttgaattttgtcaaacgctatttctgtgtcaatgaattgatctttttcttcttcttctttgctctattacatcggtaatttcagtgtgcttctttacattgattggttttcttatgttgaactacttttgcatttataagataaattcttcttggtcatagggcacaatcctgtttaggaatttggtttcctagtatttggtaaagatttttgcatttatatgtgtaaaaaatattctcctgtaattttctttacttgtgatctcttcatctgaacttacactaggggaaatgcttgtctcatagaatgaattaataagtaatatctccatttctgtttttggaaaagtttgccaagcaatttctgccagttcatctctaaatgtatcctagaagttactattaaaaccatctggtattcgcggtagctcatgcctgtaatcccagcactttgggaggccaaggcaggcggatcacgaggtcaggagatcgagaccatcctggctaacacggtgaaaccccgtctctactgaaaatacaaaaaattagccgggcgagatggcgggcgcctgtagtcccagctacttgggaggctgaggcaggagaatggcgtgaacccaggaggcggagcttgcagtgagccgagatcacgccactgcactccagcctgggtgacagagcaagactccgtctcaaaaacaaaaaaacaaaaaacaaaaccatctggtaggtatcataattttcttgattgggtgggttttttactacaacttctatttctttacctgttattggtctgttgacatatatttattatttcttcttgagtgagcttaggtaattagtgtgtttctagaaaattcaacaatttcatctaggttatctagtttatggcctaatttggtcatattattctcacaatcatttttatttctataaggtcagtagtaatagccccagttttatttctgatttcagttatttattatctcttttcttctttatcagtatagatttgtcaattttgtcgattttttcatagaatcagcttttggttttattatttctttctctataattcctgccctgtattgtatgtatttccattttaattatcattatttcctcccttctacttgtgtttaatttgctcttcttttctggttcataaaagttcgaagttatattattgatttgagatcttttgtacatttttaaatgtaggctcttacaactataaattttcatctgagcactgcttttgcttcatctcataagtttagtatgttgtgttattacatatcttcagatatttgtaatttctcttcttcgatccattgcttgaaaaggcactcatggtttaattgccatatattgtacatttttcagtttttctcctgctgttgatttaaagttccattccattgtgttctgagaagatgctgtgtataagtttaatgtttttaaaatatactgaagaattctttgttgcctaacacatgggctatcagagagaacatgtattctgctgttgttgggtggaatgtcctgtgtatgtctattaggtatagttgatttatataaacactatactttaattcccctatttccttgttgcagattttctatcaagaatttgaagtggcctattgatgtctccaactattattgcagaactacacattctttccctaaattttgccaatgtttgctttgtatattttgggggctctgttgtttagtgtgtgcatatttataactgttatatcttcttgataaattgatccttttattagtgtttaatgcccttgttccaattgtaacagtggttaaagtcaattcatgtcatattagtagagccacaccacctctcttttggttaccatttgtatggaatatatttttctgtttttcactttcaatttatttgtggcttgcatctaaattgagtctcttatagaaaatatgtagttgtatgattttaaaaatccattacactgatttttgcctctcaattggaaagtttacttcatttacttttatagaaattattgatgagaattactactgccattttgctttttgttttctataattttttgttcatttcttcccttaatactttttttgtgattagttgatttttatagtgaaatgttttaaaaagctttgtcattttcttatgtgtgcattttaaaaaaattgtctctaactgccataaggattctatttaataaatttataatcatctatgttttaattaatgcgaacataatttcaatagcatgaaacactccatatctatgtagtccccttacccatttcatgttgtttcacaaattacattcatatacattctgtgctgaataacataaatttataattatttttataaatttttttcaacacatatagaaaataaaaatggagttataaactaaaaataaaataatgctaagttttataattgcccatggacttactttttccaggaaacctttatttcttcattcatctttaagttattgtctagtgtcttttcatttcaacctgaaggaatctgtttagcatttttcactggacaggtctgcaagttataaactccttcatcttttgtttctctttaaatgtattaattttttactcatttatcacagaatgttttgctagataaagaattctcagtaagtagttgttattgtttttggtctttctttcaggactaaaacatgttattccactatcttctcacctccatcatttataatgagaaatcagctattaatcttattgaaaatcccttgtaaataataaattgattttccctagctacttgcaaaattgtctgtctttagctttcaataatttgacaactgtatgtctcagtgtggatctctttatcttacttgatgtttattcatgtttcttgaatttgtatatttatgtctttcatcaaatatggaaagttttcagccattatttcttcaaatatttgtcctgccttttctctctgtcatctttttctgggattctccttcatatgttggtccccttgatggcatttcacaagccccttaggtgccatttacttttctttattatttttttttctacttctcagacttgatagatagaatagataatttctatcaccctattgtgaatttcctgattttgccttttggctggtaaaatttgtgttgaatttctctatttaatttttttattccagtttttatactttaaagctccagaatttttggctccttttatagtttttctttattgatatttttattttgttcatttattatatttctgatttttcttatttggttgttcaggttttccttcaattatttgagcatgtttaagataatttttaaaaataatctttttgccggcaattacaacatctagacatttttagggatggtagttgttaatttattttgttctattaaataagtcttatttcctatttctttgtatgccttgtgatttttttgttaaaaaaatggacacttgaatattacaatgtgattctggaaatcaaatgttcctacttctcagggtttgctcttttgtaattattgaaggctgtagtaaactcttggtataatgacatttctctactgtttttcagcaaatatatttgttgcatatattgtgaataaagtttttgttctttggctttttttgttcagctaatgtttgacagagttttcttgaacaccaggaactaaaaaaaacaacaaccaaccaaacaacctctctctgtctttactgtttggctctgtctgagtacctctttaaacacttagccagacttgcattaaggttagggatatgtagactaaataaagaatatgtggtacatatataccatggaatattatgtagccataaaaaggaacaagattatgtcatttgcagggacatggatggagttggaagccattattctcagcaaactaatgcagaaacagaaaaccaaacactgcatggtctcacttctaagtgggagctgaaccgtgagaacacatgaacacatggggggaaacaacacacactgaggcctgttaagggtggtaggggctggcaggagtgaaaacatcaggaagaatagctaacggatgctgggcttaataactagatgatgagttgatctgtgcagcaaactaccatagcacacatttacctatgtaacaaacctgcacatctgcacatgtaccccagaacttaaaataaaggttgaaaaaataaaagtttagggatcagtatcagacaaaacaaagatccaaaacactataaaacttaaggacttcttaggtattttttgaacatgcactgtataattggcatgtatgaggcttttcaaatctctcctaactcatgggtgttttttattaccctaattttccaaggaatatctctgttcttattgtgtttccaggccttggatatttgtttatatatcttaaatgtcttttgcctcaagcttaggtttcttaggagtccaacaatatatttaagcaactcccaccacttttaccgcttggatatgctgtgcaatagacaaaacagatgaaagcaccttacatcattcctccaggtagcccccatagaggttaaaacgggccaaaataatttgcaaatgaagttgtctcttctacctctggaaacagggactattctctcacactgggaacgtgggctgctgtctgcaagactgctcttcaactggggagtggttatagaaagggaaagtaaaactgccacaatgattttttattatttttacattgacattttattgctttagtgttcactgtgttgctataaacctgtctgttttccagtgttctgacaatgttgattctgatggcttctactcatttttcaatatttctatggagggacagaagcttggagttgccaaatgcgacatcttgcttatgtcactccctcctatctgttttagtaaacttttttgtgtgcgtgtgacaatacaacaatttaaatttattgcatatactcgtggctgctgttttgctacaatgagttgagttcaaccaagattatataccctacaaaaaactaaagcacttattatctggccaattgaaaaaaaaaacattttctgacctctgctctagactggtaaagttcagatttcacaaatttcaaatagataacttcctttatagccactttgtttttatagtccgccttcacatttaatgagtctacatttattacttagtacttggtatataccaaaaattcttgatctctttcctgaaattttacatctactttagagttaaaaaaataactagaactcagagcatctcagaaatgttcagtctcagcaagctagtgaatgttttactgtgaacagattcacaggctttactgattccagagccaaaatgctaataagtttaaacatatattttggataaaattgatctgcctccataacaaaggcactggtcttacagttaacctgtaaatcagttgtggatgtaaaggcattattgccaattcaatttggttgagatgagctttagtattcaatcctattgttctgagtgtcaattagagccaagagtgagcctacaatgttatcgatgttatcgattctcctccagctgagaacaaagttctagaatggccagctcatttttctggtctttattaacctaggcagcctacacctgcatttatatttaattatcataatgagcttctttttaaaatagtatcacagagggggatcagagtgtttgttcattaaatctctaatgaaacattgtatgtagcataaatgtattattctggattatattacatcacatcaaagtacagaatttaacagaatgtatcccaaactccataatagtttggccagatacagaaacaatttccttcatccctactgagagcagactgagttgtggaattcccaaatatagctttcattgaaatggatgggacttctaagatcagtagtagcatttatatgatgttattcttcaattgtaagccattaatttgattagttatccatttgcatttttacttgttatactgatttcattgcaaactggagaaaaaataaaggaaaaacaagcaagaagatttaactttacaaatgtttcatttccactaatttctactatttaaaaaaagaaatgtaaattgaagcagcataacttaggcaaaaagcattggattcatatttggagtcctggattctactcacaactctgataataattagctgctgcttcttttttttttttttttttgagacggagtctcactctgttgccaggctggagtacagcggcacaatctctcctcactgcaactctgcctcccaggttcaagtgattctcctgcctcagcctcctgagtagctgggactacaggtgcgtgccaccatgcctggctaattttttttttttttttttttggattttagtagagatggagtttcaccatgttggccaggatggtctcgatctcctgacctcatgatttgcccgcctgggtctcccaaagtgctgggattacaggtgtgagccacagtgccttgcctaataattagcttcttaagcttgggcaagtaatgaccattgtgtttcactttaaaattaatgataaaattaatcattttatcagtgatacaattaatcattttatcagtgataaaattaatgtgtaagaaggtattgtctctgcttcagaaaaatatgtgctgtatgttattgttttcactgggaaagaattggcaaattccatattttatattaagctcctcaaattttatgttcctcattgtgggttcattctgtacttaaccttgtattataagacttgctattgtggatgctgtggatgccaaggcccttgtcccactgtggttttactaaaaatctagttgcaaaaggcagattaggaggaaaaaaagacttagaaattcatttaatgagtatacacggcagccttccaaatgcagaccctaagatacaggggaaattaacaaagtatggacagctgtgtagaaatactattggaagaaaggtatatgacctaataatgctaatagactgggtagggaaacccagcaaggcctgtcagtctagatttttcttgacatttctaagcatgtgtttttttcttcttctggttatggggcagcaacatctttggagtgggggtcttaagatgttcagtcaaacgaggtaagtcagataatttctttatggccagttttcacacagataaagtggaggaaaaatcagagtaatatatttaggttttatggctagctttaaagaaaaggggttctaggggttctgtttactatgacccactgttgtggaagagagattctagtttccatggccagccttatgggagaataaaactgagagacaagaggacaggagaaggtcagagaaaaatgtttgtttctgaggctgctgctgagcctttcatttgggggttttgttttctgatccccagaactatcctacattgtaattgcctatttacttgtctgagttccctagttagaccctgtgctccttgaaggcagtgagtagtttttaaatactattttactcaattgcaattgcttaatatctggcacacagcaggacctctacaaatatctgtgcatgaaagaatataattttcatcactcattctattctgaaatgcacacacacacatacacacactgatgaatcaatcaatggataaacagacaggtagataacagctaatagaaaataatgactgcaggttgtataacacaatcaaagtgtttgttgttgtttattttctttgaaattaactggcatgctcgatctcattgacactagcatcaaaatacctgatattattagccgtgacatatgttaactagtggtttctatgactgcttcccatcactactccccacctcagtgatccttagtgatccatttgctcatcaaattgaaactaatttccccaaagcaaggctattatgaatttgaaaaagttgattatttccgagcagataactttaaatgtcatggagcctatttaaagacagctttatagcacaaaccttctgttcaagccttaatgtacaaccaaatggaccaaatgaggcaaacagaatcaggcttccaaatataatcataattctagattagctctcaaaataagactgcagttcatatattctacaaagtatgttttgacattaaatgtaatatactgaggattatttttctgatttacacttgctttggtttctacctttgggtaggtggctctgactgtgaaaaagtcgctgtgagcctgccaggctacatctccctcccagaggtgaaatcatgccctattctccacattgcctttgccttcagattcttatttacatactaatgtttcacaatgtttttttttctcttccttctaaacctaagcagagatatttcctctacctagtgttattcattgtgaggagaggaattttttcttgcaggtgggagagtatagataagggtaataaaattcccatagttttttgttttgtttttgtttttgtttttctgggcatgaactagtagtatttattttcttttaaatcacaaagtatgattgttgtagcacttcttctcagttctattttcttttttaaaaaacaactgtaaattcaattgtacaggcagtttcaagtaatcaaaacgtaatgtattaatcttgacatctgtggtttgtggattcaaatccctacattctctagcttgtaatgtttatgaggtagtggatgtgaagagttcataagtcaaattcacatttaatttgtactggtttcatcattcatcacaaaatatgctactgaacaacagtgagtatgctgttgatatgtaaatgcacaaatatacatgcacacaacatataacaaagcagtttttatgatgtacctcttgcattacaatactcttatgtagctatacaactcctacaagacataaagtaaacacaaaagctattttcttcacttgcatgtatgtagatgtatcctagagaaatgctattgttcctcagaaatggtatttgtaaatgaattttttttaattagacaaacccaaagtactatactatggagtaagtttgtcttattttgtttttaatcagtgaatatagatgactagttcattcacttagtctttcagaagagttttaatatcaaaattatcatatggtctgacttt
